US012305176B2

(12) United States Patent
Bevan et al.

(10) Patent No.: US 12,305,176 B2
(45) Date of Patent: May 20, 2025

(54) POLYNUCLEOTIDES FOR EXPRESSION OF RNA-GUIDED NUCLEASES AND DNA BINDING PROTEINS IN SOYBEAN

(71) Applicant: INARI AGRICULTURE TECHNOLOGY, INC., Cambridge, MA (US)

(72) Inventors: Scott A. Bevan, Cambridge, MA (US); Adam Patrick Joyce, Stow, MA (US)

(73) Assignee: INARI AGRICULTURE TECHNOLOGY, INC., Cambridge, MA (US)

( * ) Notice: Subject to any disclaimer, the term of this patent is extended or adjusted under 35 U.S.C. 154(b) by 19 days.

(21) Appl. No.: 17/906,947

(22) PCT Filed: Mar. 29, 2021

(86) PCT No.: PCT/US2021/024681
§ 371 (c)(1),
(2) Date: Sep. 21, 2022

(87) PCT Pub. No.: WO2021/202397
PCT Pub. Date: Oct. 7, 2021

(65) Prior Publication Data
US 2023/0175001 A1    Jun. 8, 2023

Related U.S. Application Data

(60) Provisional application No. 63/075,395, filed on Sep. 8, 2020, provisional application No. 63/072,585, filed on Aug. 31, 2020, provisional application No. 63/001,806, filed on Mar. 30, 2020.

(51) Int. Cl.
*C12N 15/82* (2006.01)

(52) U.S. Cl.
CPC .............. *C12N 15/8213* (2013.01)

(58) Field of Classification Search
None
See application file for complete search history.

(56) References Cited

U.S. PATENT DOCUMENTS

| | | | |
|---|---|---|---|
| 5,380,831 A * | 1/1995 | Adang | C12N 15/8216 435/91.1 |
| 6,072,050 A | 6/2000 | Bowen et al. | |
| 2015/0059010 A1 | 2/2015 | Cigan et al. | |
| 2018/0273960 A1* | 9/2018 | Cigan | A01H 4/008 |
| 2019/0040405 A1* | 2/2019 | Cigan | C12N 15/63 |
| 2019/0144852 A1 | 5/2019 | Zhao et al. | |
| 2019/0264218 A1 | 8/2019 | Shultz et al. | |
| 2019/0352655 A1 | 11/2019 | Niu et al. | |
| 2021/0147862 A1 | 5/2021 | Hummel et al. | |

FOREIGN PATENT DOCUMENTS

CN    106834341 A    6/2017

OTHER PUBLICATIONS

Keskin, Ozlem, et al. "A new, structurally nonredundant, diverse data set of protein-protein interfaces and its implications." Protein Science 13.4 (2004): 1043-1055. (Year: 2004).*
Thornton, Janet M., et al. "From structure to function: approaches and limitations." nature structural biology 7.11 (2000): 991-994. (Year: 2000).*
Guo, Haiwei H., Juno Choe, and Lawrence A. Loeb. "Protein tolerance to random amino acid change." Proceedings of the National Academy of Sciences 101.25 (2004): 9205-9210. (Year: 2004).*
GenBank Accession KR154349.1 "Synthetic construct scas9 gene, complete cds" dated Nov. 15, 2015 ncbi.nlm.nih.gov/nucleotide/KR154349.1?report=genbank&log$=nuclalign&blast_rank=6&RID=2WPPF6KN013 (Year: 2015).*
Al-Shayeb et al., "Clades of huge phages from across Earth's ecosystems," Nature, Feb. 20, 2020, vol. 578, pp. 425-431, 23 pages.
Bai et al., "Generation of a multiplex mutagenesis population via pooled CRISPR-Cas9 in soya bean," Plant Biotechnology Journal, Mar. 2020, vol. 18, Issue 3, pp. 721-731.
Cai et al., "CRISPR/Cas9-Mediated Genome Editing in Soybean Hairy Roots," PLOS One, Aug. 18, 2015, vol. 10, No. 8, 13 pages.
International Search Report and Written Opinion in PCT/US2021/024681, mailed Sep. 23, 2021, 19 pages.
Khandelwal et al., "A Phenomenological Model for Predicting Melting Temperatures of DNA Sequences," PLOS One, Aug. 26, 2010, vol. 5, Issue 8, 9 pages.
Madeira et al., "The EMBL-EBI search and sequence anaylysis tools APIs in 2019," Nucleic Acids Research, Apr. 12, 2019, vol. 47, pp. W636-W641.
Puigbo et al., "CAIcal: A combined set of tools to assess codon usage adaptation," Biology Direct, Sep. 16, 2008, vol. 3, No. 38, 8 pages.
Cai et al., "CRISPR/Cas9-Mediated Genome Editing in Soybean," Chinese Academy of Agricultural Sciences Dissertation, Apr. 2016, 70 pages.
Michno et al., "CRISPR/Cas mutagenesis of soybean and Medicago truncatula using a new web-tool and a modified Cas9 enzyme," GM Crops & Food, Oct. 2015, vol. 6, pp. 243-252.
Michno et al., "CRISPR/Cas mutagenesis of soybean and Medicago truncatula using a new web-tool and a modified Cas9 enzyme," GM Crops & Food, Supplemental Figures, Oct. 2015, 2 pages.
Michno et al., "CRISPR/Cas mutagenesis of soybean and Medicago truncatula using a new web-tool and a modified Cas9 enzyme," GM Crops & Food, Supplemental Text, Oct. 2015, 2 pages.

(Continued)

*Primary Examiner* — Charles Logsdon
*Assistant Examiner* — Kelsey L McWilliams
(74) *Attorney, Agent, or Firm* — McKee, Voorhees & Sease, PLC

(57) ABSTRACT

Methods for obtaining plant cells, plants, and plant parts, including soybean plant cells, plants, and plant parts, comprising synthetic polynucleotides that provide for increased expression of encoded RNA-guided endonucleases (RGEs), RNA guided nickase (RGNs), and RNA guided DNA binding proteins are disclosed. Also provided are soybean plant cells, plants, and plant parts comprising synthetic polynucleotides that provide for increased expression of encoded RNA-guided endonucleases (RGEs), RNA guided nickase (RGNs), and RNA guided DNA binding proteins.

10 Claims, 3 Drawing Sheets

Specification includes a Sequence Listing.

(56) References Cited

OTHER PUBLICATIONS

Search Report in CN2021800253342, mailed Jul. 20, 2023, 4 pages.
Ali Z, Abul-Faraj A, Li L, Ghosh N, Piatek M, Mahjoub A, Aouida M, Piatek A, Baltes NJ, Voytas DF, Dinesh-Kumar S. Efficient virus-mediated genome editing in plants using the CRISPR/Cas9 system. Molecular plant. Aug. 3, 2015;8(8):1288-91.
Ali Z, Abul-Faraj A, Li L, Ghosh N, Piatek M, Mahjoub A, Aouida M, Piatek A, Baltes NJ, Voytas DF, Dinesh-Kumar S. Efficient virus-mediated genome editing in plants using the CRISPR/Cas9 system. Molecular plant. Aug. 3, 2015;8(8):1288-91, Supplementary Information.
Extended European Search Report in EP21780273.5, mailed Apr. 3, 2024, 8 pages.
Kanazashi Y, Hirose A, Takahashi I, Mikami M, Endo M, Hirose S, Toki S, Kaga A, Naito K, Ishimoto M, Abe J. Simultaneous site-directed mutagenesis of duplicated loci in soybean using a single guide RNA. Plant cell reports. Mar. 2018;37:553-63.
Li Z, Liu ZB, Xing A, Moon BP, Koellhoffer JP, Huang L, Ward RT, Clifton E, Falco SC, Cigan AM. Cas9-guide RNA directed genome editing in soybean. Plant physiology. Oct. 1, 2015;169(2):960-70.
Xu H, Zhang L, Zhang K, Ran Y. Progresses, challenges, and prospects of genome editing in soybean (*Glycine max*). Frontiers in Plant Science. Oct. 22, 2020;11:571138.

* cited by examiner

_Glycine max_ [gbpln]: 1207 CDS's (495060 codons)

fields: [triplet] [frequency: per thousand] ([number])

```
UUU 21.2( 10493)   UCU 18.4(  9107)   UAU 15.7(  7779)   UGU  8.1(  3995)
UUC 21.2( 10487)   UCC 12.9(  6409)   UAC 14.9(  7367)   UGC  8.0(  3980)
UUA  9.2(  4545)   UCA 15.6(  7712)   UAA  0.9(   463)   UGA  1.0(   480)
UUG 22.9( 11340)   UCG  4.8(  2397)   UAG  0.5(   263)   UGG 13.0(  6412)

CUU 23.9( 11829)   CCU 18.9(  9358)   CAU 14.0(  6930)   CGU  6.6(  3291)
CUC 17.1(  8479)   CCC 10.1(  5010)   CAC 11.6(  5759)   CGC  6.2(  3093)
CUA  8.5(  4216)   CCA 19.1(  9461)   CAA 20.5( 10162)   CGA  4.1(  2018)
CUG 12.7(  6304)   CCG  4.7(  2312)   CAG 16.2(  8038)   CGG  3.1(  1510)

AUU 25.1( 12411)   ACU 17.1(  8490)   AAU 22.4( 11088)   AGU 12.6(  6237)
AUC 16.3(  8071)   ACC 14.3(  7100)   AAC 22.8( 11284)   AGC 11.3(  5594)
AUA 12.9(  6386)   ACA 14.9(  7391)   AAA 26.9( 13334)   AGA 14.8(  7337)
AUG 22.7( 11218)   ACG  4.3(  2147)   AAG 35.9( 17797)   AGG 13.3(  6574)

GUU 26.1( 12911)   GCU 26.7( 13201)   GAU 32.4( 16040)   GGU 20.9( 10353)
GUC 11.9(  5894)   GCC 16.2(  8026)   GAC 20.4( 10097)   GGC 13.4(  6650)
GUA  7.7(  3803)   GCA 21.4( 10577)   GAA 33.2( 16438)   GGA 22.3( 11022)
GUG 21.4( 10610)   GCG  6.3(  3123)   GAG 33.2( 16426)   GGG 13.0(  6431)
```

Coding GC 45.95% 1st letter GC 52.39% 2nd letter GC 39.75% 3rd letter GC 45.69%

From the https internet site of the world wide web "kazusa.or.jp/codon/cgi-bin/showcodon.cgi?species=3847"

POLYNUCLEOTIDES FOR EXPRESSION OF RNA-GUIDED NUCLEASES AND DNA BINDING PROTEINS IN SOYBEAN

REFERENCE TO RELATED APPLICATIONS

This is a U.S. National Phase of PCT/US2021/024681, filed Mar. 29, 2021, which claims the benefit of U.S. Provisional Patent Application Nos. 63/075,395, filed Sep. 8, 2020; 63/072,585, filed Aug. 31, 2020; and 63/001,806, filed Mar. 30, 2020; which are each incorporated herein by reference in their entireties.

INCORPORATION OF SEQUENCE LISTING

A sequence listing containing the file named "10071WO01" which is 793,473 bytes (measured in MS-Windows®), comprises 188 biological sequences, and was created on Mar. 16, 2021, is electronically filed herewith via the USPTO's EFS system, and is incorporated herein by reference in its entirety.

FIELD

The disclosure is generally related to methods and compositions that contain synthetic polynucleotides which provide for increased expression of encoded RNA-guided endonucleases (RGEs), RNA guided nickase (RGNs), and nuclease-deficient RNA guided DNA binding proteins (ndRGDBP) in soybean cells, plants, and plant parts.

BACKGROUND

The CRISPR/Cas system of bacterial acquired immunity against phages and viruses has been adapted into potent new technologies for genomic modifications and gene expression control. Improvements in expression of CRISPR/Cas system components can provide for improved genomic modification frequencies and improved gene expression control.

Genes derived from different species can vary considerably with respect to average usage for synonymous codons. In plants, dicots typically have coding sequences with a lower GC content than monocots. In designing a transgene with optimal expression of an encoded protein of interest, the nucleic acid of the transgene is typically designed that mimics the codon usage of the intended host.

SUMMARY

Methods of modifying an endogenous plant gene in a plant genome, such as a soybean gene in a soybean genome comprising: introducing a guide RNA or a polynucleotide encoding a guide RNA directed to a target editing site in the endogenous soybean gene and optionally a donor template DNA molecule having homology to the target editing site into a soybean plant cell comprising a synthetic polynucleotide encoding an RNA-guided endonuclease (RGE) or RNA guided nickase (RGN), wherein said synthetic polynucleotide: (i) has a GC (guanine and cytosine) content greater than 47, 48%, or 50%; (ii) a melting temperature (Tm) greater than 89 or 90 degrees Celsius; (iii) a soybean codon adaptation index (sCAI) which is lower than the sCAI of a soybean codon-optimized reference polynucleotide encoding the RGE or the RGN; or any combination of i, ii, and iii; and selecting a modified plant cell or soybean plant cell, plant or soybean plant, plant part or soybean plant part, plant tissue or soybean tissue, or plant callus or soybean callus comprising a modification of the endogenous plant gene or soybean gene are provided.

Methods of modifying an endogenous soybean gene in a soybean genome comprising introducing into a soybean plant cell: a synthetic polynucleotide encoding an RNA-guided endonuclease (RGE) (e.g., a Cas12j RGE) or RNA guided nickase (RGN), wherein said synthetic polynucleotide has a GC (guanine and cytosine) content greater than 47, 48%, or 50%, a melting temperature (Tm) greater than 89 or 90 degrees Celsius, a soybean codon adaptation index (sCAI) which is lower than the sCAI of a soybean codon-optimized reference polynucleotide encoding the RGE or the RGN, or any combination of said GC content, said Tm, and said lower sCAI; a guide RNA or a polynucleotide encoding a guide RNA directed to a target editing site in the endogenous soybean gene; and optionally a donor template DNA molecule having homology to the target editing site; and selecting a modified soybean plant cell, soybean plant, soybean plant part, soybean tissue, or soybean callus comprising a modification of the endogenous soybean gene are provided.

Methods of modifying expression of an endogenous soybean gene in a soybean genome comprising: introducing into a soybean plant cell: (i) a synthetic polynucleotide encoding a protein comprising a nuclease deficient RNA-guided DNA binding protein (ndRGDBP; e.g., a Cas12j ndRGDBP), wherein said synthetic polynucleotide has a GC (guanine and cytosine) content greater than 47%, 48%, or 50%, a melting temperature (Tm) greater than 89 or 90 degrees Celsius, a soybean codon adaptation index (sCAI) which is lower than the sCAI of a soybean codon-optimized reference polynucleotide encoding the ndRGDBP, or any combination of said GC content, Tm, and/or sCAI; and (ii) a guide RNA or a polynucleotide encoding a guide RNA directed to a target binding site in the endogenous soybean gene; and selecting a modified soybean plant cell, soybean plant, soybean plant part, soybean tissue, or soybean callus wherein expression of the endogenous soybean gene has been modified are provided.

Soybean plant cells comprising a synthetic polynucleotide encoding a protein comprising an RNA-guided endonuclease (RGE; e.g., a Cas12j RGE), an RNA-guided nickase (RGN), or a nuclease deficient RNA-guided DNA binding protein (ndRGDB; e.g., a Cas12j ndRGDB), wherein said polynucleotide has: a GC (guanine and cytosine) content greater than 47%, 48%, or 50%; a melting temperature (Tm) greater than 89 or 90 degrees Celsius; a soybean codon adaptation index (sCAI) which is lower than the sCAI of a soybean codon-optimized reference polynucleotide encoding the RGE; or any combination of the GC content, Tm, and/or sCAI. Also provided are soybean plants, soybean plant parts including seeds or pods, and soybean tissues including meristemic, embryonic, and/or callus tissue comprising the soybean cells.

Method for obtaining any of the aforementioned or otherwise provided soybean plant cells disclosed herein comprising: (a) introducing into the soybean plant cell the synthetic polynucleotide encoding the protein comprising the RNA-guided endonuclease (RGE), the RNA-guided nickase (RGN), or the nuclease deficient RNA-guided DNA binding protein (ndRGDBP), wherein said polynucleotide has a GC (guanine and cytosine) content greater than 47%, 48%, or 50%; a melting temperature (Tm) greater than 89 or 90 degrees Celsius; a soybean codon adaptation index (sCAI) which is lower than the sCAI of a soybean codon-optimized reference polynucleotide encoding the RGE; any combination of said GC content, Tm, and/or lower sCAI;

and (b) selecting a soybean plant cell comprising the synthetic polynucleotide are also disclosed.

Isolated and recombinant nucleic acids comprising inactivating Cas12j mutations are provided.

BRIEF DESCRIPTION OF THE DRAWINGS

FIG. 1 depicts the Codon Usage Database table for *Glycine max* (soybean), from the https website on the world wide web "kazusa.or.jp/codon/."

DETAILED DESCRIPTION

Definitions

Figure 2:
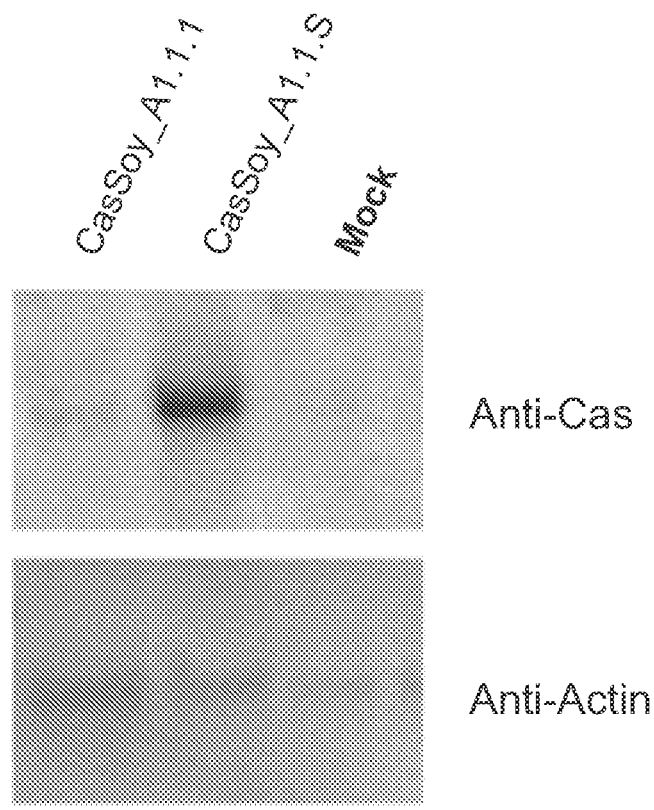
FIG. 2 shows western blot detection of soybean cell-expressed nuclease levels from expression vectors containing either the CasSoy_1.1.1 soybean codon-optimized reference polynucleotide (SCORP) with a GC content of about 37.5% (left) or the test Cas Soy 1.1.S polynucleotide having a coding sequence with a GC content of about 49.5% (center). Mock transfected control soybean cells are at right.

The term "and/or" where used herein is to be taken as specific disclosure of each of the two or more specified features or components with or without the other specified features. Thus, the term "and/or" as used in a phrase such as "A and/or B" herein is intended to include "A and B," "A or B," "A" (alone), and "B" (alone). Likewise, the term "and/or" as used in a phrase such as "A, B, and/or C" is intended to encompass each of the following embodiments: A, B, and C; A, B, or C; A or C; A or B; B or C; A and C; A and B; B and C; A (alone); B (alone); and C (alone).

As used herein, the terms "Cas12j" and "Cas(D" are used interchangeably herein to refer to the same grouping of RNA directed nucleases.

As used herein, the terms "Cpf1" and "Cas12a" are used interchangeably herein to refer to the same grouping of RNA directed nucleases.

As used herein, the terms "Cas12e" and "CasX" are used interchangeably herein to refer to the same grouping of RNA directed nucleases.

As used herein, the phrase "donor template DNA molecule," refers to a dsDNA or ssDNA molecule having homology to the target editing site. Donor template DNA molecules can be used to edit a target editing site in a genome by homology-directed repair.

"Heterologous," as used herein, means a nucleotide or polypeptide sequence that is not found in the native nucleic acid or protein, respectively. For example, relative to a RGE, RGN, or ndRGDBP polypeptide, a heterologous polypeptide comprises an amino acid sequence from a protein other than the RGE, RGN, or ndRGDBP polypeptide. In some cases, a portion of a RGE, RGN, or ndRGDBP protein from one species is fused to a portion of a Cas protein from a different species. The Cas sequence from each species could therefore be considered to be heterologous relative to one another. As another example, a RGE, RGN, or ndRGDBP protein (e.g., a dCas protein) can be fused to an active domain from a non-Cas protein (e.g., a histone deacetylase), and the sequence of the active domain could be considered a heterologous polypeptide (it is heterologous to the Cas protein).

As used herein, the terms "include," "includes," and "including" are to be construed as at least having the features to which they refer while not excluding any additional unspecified features.

As used herein, the terms "correspond," "corresponding," and the like, when used in the context of an amino acid position, mutation, and/or substitution in any given RGE, RGN, or ndRGDBP polypeptide with respect to the reference RGE, RGN, or ndRGDBP, all refer to the position, mutation, and/or substitution of the amino acid residue in the given RGE, RGN, or ndRGDBP sequence that has identity or similarity to the amino acid residue in the reference polypeptide sequence when the given RGE, RGN, or ndRGDBP polypeptide is aligned to the reference RGE, RGN, or ndRGDBP polypeptide sequence using a pairwise alignment algorithm (e.g. CLUSTAL O 1.2.4 with default parameters).

As used herein, the terms "include," "includes," and "including" are to be construed as at least having the features to which they refer while not excluding any additional unspecified features.

The terms "polynucleotide" and "nucleic acid," used interchangeably herein, refer to a polymeric form of nucleotides of any length, either ribonucleotides or deoxynucleotides. Thus, this term includes, but is not limited to, single-, double-, or multi-stranded DNA or RNA, genomic DNA, cDNA, DNA-RNA hybrids, or a polymer comprising purine and pyrimidine bases or other natural, chemically or biochemically modified, non-natural, or derivatized nucleotide bases. The terms "polynucleotide" and "nucleic acid" should be understood to include, as applicable to the embodiment being described, single-stranded (such as sense or antisense) and double-stranded polynucleotides.

The terms "polypeptide," "peptide," and "protein", are used interchangeably herein, refer to a polymeric form of amino acids of any length, which can include genetically coded and non-genetically coded amino acids, chemically or biochemically modified or derivatized amino acids, and polypeptides having modified peptide backbones. The term includes fusion proteins, including, but not limited to, fusion proteins with a heterologous amino acid sequence, fusions with heterologous and homologous leader sequences, with or without N-terminal methionine residues; immunologically tagged proteins; and the like.

The term "naturally-occurring" as used herein as applied to a nucleic acid, a protein, a cell, or an organism, refers to a nucleic acid, cell, protein, or organism that is found in nature.

As used herein the term "isolated" is meant to describe a polynucleotide, a polypeptide, or a cell that is in an environment different from that in which the polynucleotide, the polypeptide, or the cell naturally occurs. An isolated genetically modified host cell may be present in a mixed population of genetically modified host cells.

As used herein, the term "exogenous nucleic acid" refers to a nucleic acid that is not normally or naturally found in and/or produced by a given bacterium, organism, or cell in nature. As used herein, the term "endogenous nucleic acid" refers to a nucleic acid that is normally found in and/or produced by a given bacterium, organism, or cell in nature. An "endogenous nucleic acid" is also referred to as a "native nucleic acid" or a nucleic acid that is "native" to a given bacterium, organism, or cell.

"Recombinant," as used herein, means that a particular nucleic acid (DNA or RNA) is the product of various combinations of cloning, restriction, and/or ligation steps resulting in a construct having a structural coding or noncoding sequence distinguishable from endogenous nucleic acids found in natural systems. Generally, DNA sequences encoding the structural coding sequence can be assembled from cDNA fragments and short oligonucleotide linkers, or from a series of synthetic oligonucleotides, to provide a synthetic nucleic acid which is capable of being expressed from a recombinant transcriptional unit contained in a cell or in a cell-free transcription and translation system. Such sequences can be provided in the form of an open reading frame uninterrupted by internal non-translated sequences, or introns, which are typically present in eukaryotic genes. Genomic DNA comprising the relevant sequences can also be used in the formation of a recombinant gene or transcriptional unit. Sequences of non-translated DNA may be present 5' or 3' from the open reading frame, where such sequences do not interfere with manipulation or expression of the coding regions and may indeed act to modulate production of a desired product by various mechanisms (see "DNA regulatory sequences", below).

Thus, e.g., the term "recombinant" polynucleotide or "recombinant" nucleic acid refers to one which is not naturally-occurring, e.g., is made by the artificial combination of two otherwise separated segments of sequence through human intervention. This artificial combination is often accomplished by either chemical synthesis means, or by the artificial manipulation of isolated segments of nucleic acids, e.g., by genetic engineering techniques. Such is usually done to replace a codon with a redundant codon encoding the same or a conservative amino acid, while typically introducing or removing a sequence recognition site. Alternatively, it is performed to join together nucleic acid segments of desired functions to generate a desired combination of functions. This artificial combination is often accomplished by either chemical synthesis means, or by the artificial manipulation of isolated segments of nucleic acids, e.g., by genetic engineering techniques.

Similarly, the term "recombinant" polypeptide refers to a polypeptide which is not naturally-occurring, e.g., is made by the artificial combination of two otherwise separated segments of amino sequence through human intervention. Thus, e.g., a polypeptide that comprises a heterologous amino acid sequence is recombinant.

The phrase "soybean codon adaption index" (sCAI) refers to a codon adaptation index for a given polynucleotide coding sequence calculated from the soybean codon bias table of FIG. 1. In certain embodiments, an sCAI for a subject synthetic polynucleotide and a reference polynucleotide can be obtained from the http: internet site "genomes.urv.es/CAIcal/" (Puigbo et al. *Biology Direct*, 3:38) using the soybean codon bias table of FIG. 1. In certain embodiments, the sCAI for a subject synthetic polynucleotide and a reference polynucleotide can be calculated according to the following formulas, where the Relative Synonymous Codon usage values are calculated from the soybean codon bias table of FIG. 1 by the following formulas according to Sharp and Li. 1987. Nucleic Acids Research. 15(3); 1281-1295.

$$CAI = CAI_{obs}/CAI_{max}$$

$$CAI_{obs} = \left( \prod_{k=1}^{L} RSCU_k \right)^{1/L}$$

$$CAI_{max} = \left( \prod_{k=1}^{L} RSCU_{kmax} \right)^{1/L}$$

where RSCU (relative synonymous codon usage) is the RSCU value for the kth codon in the gene, $RSCU_{kmax}$ is the maximum RSCU value for the amino acid encoded by the kth codon in the gene, and L is the number of codons in the gene; and where the RCSU is calculated according to the following formula $$RSCU_{ij} = \frac{X_{ij}}{\frac{1}{n_i} \sum_{j=1}^{n_i} X_{ij}}$$

where $X_{ij}$ is the number of occurrences of the jth codon for the ith amino acid, and $n_i$ is the number (from one to six) of alternative codons for the ith amino acid.

The phrase "soybean codon-optimized reference polynucleotide" or the acronym "SCORP" refers to a polynucleotide which encodes a polypeptide, where the sequence of the reference polynucleotide is generated from the polypeptide sequence by the OPTIMIZER program set forth in Puigbo P. et al. 2007 OPTIMIZER: A web server for optimizing the codon usage of DNA sequences. Nucleic Acids Research, 35:W126-W131 and the soybean codon bias table set forth in FIG. 1.

By "construct" or "vector" is meant a recombinant nucleic acid, generally recombinant DNA, which has been generated for the purpose of the expression and/or propagation of a specific polynucleotide sequence(s), or is to be used in the construction of other recombinant polynucleotide sequences.

The terms "DNA regulatory sequences," "control elements," and "regulatory elements," used interchangeably herein, refer to transcriptional and translational control sequences, such as promoters, enhancers, polyadenylation signals, terminators, protein degradation signals, and the like, that provide for and/or regulate expression of a coding sequence and/or production of an encoded polypeptide in a host cell.

The phrases "target site" or "target editing site" as used herein refer to any or all of the polynucleotide sequences: (i) that are bound by an RGE or RGN complexed with a guide RNA; (ii) that comprise endonuclease or nickase cleavage site of an RGE or RGN complexed with a guide RNA; and/or (iii) that are bound by a donor template DNA molecule with homology to sequences adjacent to an endonuclease cleavage site of an RGE.

The phrase "target DNA binding site" as used herein refers to polynucleotide sequences that are bound by a ndRGDBP complexed with a guide RNA.

The term "transformation" is used interchangeably herein with "genetic modification" and refers to a permanent or transient genetic change induced in a cell following introduction of new nucleic acid (e.g., DNA exogenous to the cell) into the cell. Genetic change ("modification") can be accomplished either by incorporation of the new nucleic acid into the genome of the host cell, or by transient or stable maintenance of the new nucleic acid as an episomal element. Where the cell is a eukaryotic cell, a permanent genetic change is generally achieved by introduction of new DNA into the genome of the cell. In prokaryotic cells, permanent changes can be introduced into the chromosome or via extrachromosomal elements such as plasmids and expression vectors, which may contain one or more selectable markers to aid in their maintenance in the recombinant host cell. Suitable methods of genetic modification include viral infection, transfection, conjugation, protoplast fusion, electroporation, particle gun technology, calcium phosphate precipitation, direct microinjection, and the like. The choice of method is generally dependent on the type of cell being transformed and the circumstances under which the transformation is taking place (e.g., in vitro, ex vivo, or in vivo). A general discussion of these methods can be found in Ausubel, et al, Short Protocols in Molecular Biology, 3rd ed., Wiley & Sons, 1995.

"Operably linked" refers to a juxtaposition wherein the components so described are in a relationship permitting them to function in their intended manner. For instance, a promoter is operably linked to a coding sequence if the promoter affects its transcription or expression. As used herein, the terms "heterologous promoter" and "heterologous control regions" refer to promoters and other control regions that are not normally associated with a particular nucleic acid in nature. For example, a "transcriptional control region heterologous to a coding region" is a transcriptional control region that is not normally associated with the coding region in nature. In other examples, two or more distinct polynucleotide sequences encoding distinct polypeptide components can be operably linked. When two distinct polypeptide components (e.g., an RGE, RGN, or a ndRGDBP and a heterolous polypeptide) are operably linked, a fusion polypeptide where each distinct polypeptide component can perform its intended function is produced. In certain embodiments, such fusion polypeptides can be produced by transcription and translation of the operably linked polynucleotides or by translation of the operably linked polynucleotides (e.g., where the polynucleotide is an RNA molecule).

A "host cell," as used herein, denotes an in vivo or in vitro eukaryotic cell, a prokaryotic cell, or a cell from a multicellular organism (e.g., a cell line) cultured as a unicellular entity, which eukaryotic or prokaryotic cells can be, or have been, used as recipients for a nucleic acid (e.g., an expression vector), and include the progeny of the original cell which has been genetically modified by the nucleic acid. It is understood that the progeny of a single cell may not necessarily be completely identical in morphology or in genomic or total DNA complement as the original parent, due to natural, accidental, or deliberate mutation. A "recombinant host cell" (also referred to as a "genetically modified host cell") is a host cell into which has been introduced a heterologous nucleic acid, e.g., an expression vector. For example, a subject prokaryotic host cell is a genetically modified prokaryotic host cell (e.g., a bacterium), by virtue of introduction into a suitable prokaryotic host cell of a heterologous nucleic acid, e.g., an exogenous nucleic acid that is foreign to (not normally found in nature in) the prokaryotic host cell, or a recombinant nucleic acid that is not normally found in the prokaryotic host cell; and a subject eukaryotic host cell is a genetically modified eukaryotic host cell, by virtue of introduction into a suitable eukaryotic host cell of a heterologous nucleic acid, e.g., an exogenous nucleic acid that is foreign to the eukaryotic host cell, or a recombinant nucleic acid that is not normally found in the eukaryotic host cell.

The term "conservative amino acid substitution" refers to the interchangeability in proteins of amino acid residues having similar side chains. For example, a group of amino acids having aliphatic side chains consists of glycine, alanine, valine, leucine, and isoleucine; a group of amino acids having aliphatic-hydroxyl side chains consists of serine and threonine; a group of amino acids having amide-containing side chains consists of asparagine and glutamine; a group of amino acids having aromatic side chains consists of phenylalanine, tyrosine, and tryptophan; a group of amino acids having basic side chains consists of lysine, arginine, and histidine; and a group of amino acids having sulfur-containing side chains consists of cysteine and methionine. Exemplary conservative amino acid substitution groups are: valine-leucine-isoleucine, phenylalanine-tyrosine, lysine-arginine, alanine-valine, and asparagine-glutamine.

A polynucleotide or polypeptide has a certain percent "sequence identity" to another polynucleotide or polypeptide, meaning that, when aligned, that percentage of bases or amino acids are the same, and in the same relative position, when comparing the two sequences. Sequence similarity can be determined in a number of different manners. To determine sequence identity, sequences can be aligned using the methods and computer programs, including BLAST, available over the world wide web at ncbi.nlm.nih.gov/BLAST. See, e.g., Altschul et al. (1990), /. Mol. Biol. 215:403-10. Another alignment algorithm is FASTA, available in the Genetics Computing Group (GCG) package, from Madison, Wisconsin, USA, a wholly owned subsidiary of Oxford Molecular Group, Inc. Other techniques for alignment are described in Methods in Enzymology, vol. 266: Computer Methods for Macromolecular Sequence Analysis (1996), ed. Doolittle, Academic Press, Inc., a division of Harcourt Brace & Co., San Diego, California, USA. Of particular interest are alignment programs that permit gaps in the sequence. The Smith-Waterman is one type of algorithm that permits gaps in sequence alignments. See Meth. Mol. Biol. 70: 173-187 (1997). Also, the GAP program using the Needleman and Wunsch alignment method can be utilized to align sequences. See /. Mol. Biol. 48: 443-453 (1970). CLUSTAL and MUSCLE are other commonly used alignment programs.

As used herein, the terms "treatment," "treating," and the like, refer to obtaining a desired trait, pharmacologic and/or physiologic effect. The effect can be to confer a desired trait (e.g., improved yield, resistance to insects, fungi, bacterial pathogens, and/or nematodes, herbicide tolerance, abiotic stress tolerance (e.g., drought, cold, salt, and/or heat tolerance), protein quantity and/or quality, starch quantity and/or quality, lipid quantity and/or quality, secondary metabolite quantity and/or quality, and the like, all in comparison to a control plant that lacks the modification. The effect may be prophylactic in terms of completely or partially preventing a disease or symptom thereof and/or may be therapeutic in terms of a partial or complete cure for a disease and/or adverse effect attributable to the disease. "Treatment," as used herein, covers any treatment of a disease in a plant or mammal, e.g., in a human, and includes: (a) preventing the disease from occurring in a subject which may be predisposed to the disease but has not yet been diagnosed as having it; (b) inhibiting the disease, e.g., arresting its development; and (c) relieving the disease, e.g., causing regression of the disease.

As used herein, "Tm" is the melting temperature of the double stranded DNA sequence calculated using the following formula:

$$Tm(° C.)=(7.35×E)+[173.34×\ln(\text{Len})]+[4.96×\ln(\text{Conc})]+[0.89×\ln(\text{DNA})]-25.42$$

where Tm=Predicted melting temperature; E=DNA strength parameter per base=Cumulative DNA strength parameter/length of DNA sequence; Len=Length of nucleotide sequence (number of base pairs); Conc=[Na+] concentration of the solution (Molar)=0.16M; DNA=total nucleotide strand concentration=0.0001 g/mL, according to the method of Khandelwal G, Bhyravabhotla J (2010) PLoS ONE 5(8): e12433. doi.org/10.1371/journal.pone.0012433.

It is to be understood that this disclosure is not limited to particular embodiments described, as such may, of course, vary. It is also to be understood that the terminology used herein is for the purpose of describing particular embodiments only, and is not intended to be limiting, since the scope of the present disclosure will be limited only by the appended claims.

Unless defined otherwise, all technical and scientific terms used herein have the same meaning as commonly understood by one of ordinary skill in the art to which this disclosure belongs. Although any methods and materials similar or equivalent to those described herein can also be used in the practice or testing of the present disclosure, the preferred methods and materials are now described. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise. Thus, for example, reference to "a synthetic polynucleotide" or "subject synthetic polynucleotide" includes a plurality of such polynucleotides and reference to "the guide RNA" includes reference to one or more guide RNAs and equivalents thereof known to those skilled in the art, and so forth. It is further noted that the claims may be drafted to exclude any optional element. As such, this statement is intended to serve as antecedent basis for use of such exclusive terminology as "solely," "only" and the like in connection with the recitation of claim elements or use of a "negative" limitation.

It is appreciated that certain features of the disclosure, which are, for clarity, described in the context of separate embodiments, may also be provided in combination in a single embodiment. Conversely, various features of the disclosure, which are, for brevity, described in the context of a single embodiment, may also be provided separately or in any suitable sub-combination. All combinations of the embodiments pertaining to the disclosure are specifically embraced by the present disclosure and are disclosed herein just as if each and every combination was individually and explicitly disclosed. In addition, all sub-combinations of the various embodiments and elements thereof are also specifically embraced by the present disclosure and are disclosed herein just as if each and every such sub-combination was individually and explicitly disclosed herein.

To the extent to which any of the preceding definitions is inconsistent with definitions provided in any patent or non-patent reference incorporated herein by reference, any patent or non-patent reference cited herein, or in any patent or non-patent reference found elsewhere, it is understood that the preceding definition will be used herein.

Description

The present disclosure provides soybean plant cells, plants, and plant parts (e.g., seeds, embryos, and/or meristematic tissues) comprising synthetic polynucleotides that provide for increased expression of encoded RNA-guided endonucleases (RGEs), RNA guided nickases (RGNs), and nuclease-deficient RNA guided DNA binding proteins (ndRGDBP). The present disclosure also provides plant cells, plants, and plant parts (e.g., seeds, embryos, and/or meristematic tissues), such as soybean or corn plant cells, plants, and plant parts, comprising synthetic polynucleotides that provide for increased expression of encoded RNA-guided endonucleases (RGEs) and nuclease-deficient RNA guided DNA binding proteins (ndRGDBP). Also provided are methods of using the synthetic polynucleotides and plants or plant materials (e.g., soybean cells, soybean plants, and soybean plant parts comprising the synthetic nucleotides) to obtain improved genomic modification frequencies and improved gene expression control in those plants or plant materials (e.g., soybean cells, soybean plants, and soybean plant parts). Methods of making the plants or plant materials (e.g., soybean cells, soybean plants, and soybean plant parts) comprising the synthetic polynucleotides are also provided. Also provided are compositions comprising the plant cells (e.g., soybean cells) and the synthetic polynucleotides. In certain embodiments, expression of the synthetic polynucleotides encoding the RGEs, RGNs, ndRDGPs, or fusion polypeptides comprising the same is increased in comparison to expression of a soybean codon-optimized reference polynucleotide (SCORP) encoding the same RGEs, RGNs, ndRDGPs, or fusion polypeptides. Such increases in expression can be reflected in increased accumulation and/or biological activity (e.g., frequencies of modifying the sequence and/or expression of an endogenous soybean gene) of the RGEs, RGNs, ndRDGPs, or fusion polypeptides in soybean cells, soybean plants, and soybean plant parts in comparison to control soybean cells, soybean plants, and soybean plant parts comprising a SCORP encoding the RGEs, RGNs, ndRDGPs, or fusion polypeptides.

Subject synthetic polynucleotides encoding the RGEs, RGNs, and ndRGDBP disclosed herein can be distinguished from soybean codon-optimized reference polynucleotide (SCORP) by one or more features that include an increased GC (guanine and cytosine) content in comparison to the SCORP, an increased melting temperature (Tm) in comparison to the SCORP, a soybean codon adaptation index (sCAI) which is lower than the sCAI of the SCORP, or any combination of such increases in GC content, increases in Tm, and decreases in sCAI. In certain embodiments, the GC content of the subject synthetic polynucleotides is about 46% to about 47%, 48%, 49%, 50%, 51%, 52%, 53%, 54%, 55%, or 56%. In certain embodiments, the GC content is increased by at least about 6, 7, 8, 9, 10, 11, 12, or 13% in comparison to the GC content of the SCORP. In certain embodiments, the GC content is increased by at least about 6, 7, or 8 to about 9, 10, 11, 12, 13, 14, or 15% in comparison to the GC content of the SCORP. In certain embodiments, the Tm is increased by at least about 2, 3, 4, 5, or 6 degrees Centigrade in comparison to the Tm of the SCORP. In certain embodiments, the Tm content is increased by at least about 2 or 3 to about 4, 5, or 6 degrees Centigrade in comparison to the Tm of the SCORP. In certain embodiments, the sCAI is decreased by at least about 0.01, 0.02, 0.03, 0.04, or 0.05 in comparison to the sCAI of the SCORP. In certain embodiments, the sCAI is decreased by at least about 0.01 or 0.02 to about 0.03, 0.04, or 0.05 in comparison to the sCAI of the SCORP.

Subject synthetic polynucleotides encoding the RGEs, RGNs, and ndRGDBP disclosed herein can be operably linked to one or more distinct polynucleotide sequences encoding heterologous polypeptides. In certain embodiments, the subject synthetic polynucleotides are operably linked to a second polynucleotide sequence encoding a nuclear localization signal (NLS), a chloroplast transit peptide (CTP), an epitope tag (ST), a transcriptional activation domain (TAD), a transcriptional repressor domain (TRD); or combination thereof. In other embodiments, the subject synthetic polynucleotides (or subject synthetic polynucleotides that further comprise an operably linked second polynucleotide) are operably linked to a third polynucleotide sequence encoding a heterologous polypeptide having an enzymatic activity that modifies target DNA. In certain embodiments (e.g., for soybean), any of the aforementioned distinct, second, or third polynucleotides encoding distinct polypeptides can also be distinguished from soybean codon-optimized reference polynucleotide (SCORP) encoding those same distinct peptides by one or more features that include an increased GC (guanine and cytosine) content in comparison to the SCORP, an increased melting temperature (Tm) in comparison to the SCORP, a soybean codon adaptation index (sCAI) which is lower than the sCAI of the SCORP, or any combination of such increases in GC content, increases in Tm, and decreases in sCAI. Such distinct, second, or third polynucleotide comprising an increased GC (guanine and cytosine) content in comparison to the SCORP, an increased melting temperature (Tm) in comparison to the SCORP, a soybean codon adaptation index (sCAI) which is lower than the sCAI of the SCORP can be obtained by "back translation" or "reverse translation" (i.e., using a protein sequence and a codon usage table having more GC-rich codons than the soybean codon bias table of FIG. 1 to generate a DNA sequence) of the distinct polypeptides. Reverse translation or back translation programs that will accept a polypeptide sequence and a codon bias table as input to generate a polypeptide sequence include the Reverse Translate function on the world wide web internet site "bioinformatics.org/sms2/rev_trans.html" (Stothard P (2000) Biotechniques 28:1102-1104) and the "EMBOSS Backtranseq" function on the world wide web internet site "ebi.ac.uk/Tools/st/emboss_backtranseq/" (Madeira et al. Nucleic Acids Research, 30 Jun. 2019, 47(W1):W636-W641 DOI: 10.1093/nar/gkz268). In certain embodiments, the GC content of the aforementioned distinct, second, or third polynucleotides is about 46% to about 47%, 48%, 49%, 50%, 51%, 52%, 53%, 54%, 55%, or 56%. In certain embodiments, the GC content of the aforementioned distinct, second, or third polynucleotides is increased by at least about 6, 7, 8, 9, 10, 11, 12, or 13% in comparison to the GC content of the SCORP. In certain embodiments, the GC content of the aforementioned distinct, second, or third polynucleotides is increased by at least about 6, 7, or 8 to about 9, 10, 11, 12, 13, 14, or 15% in comparison to the GC content of the SCORP. In certain embodiments, the Tm of the aforementioned distinct, second, or third polynucleotides is increased by at least about 2, 3, 4, 5, or 6 degrees Centigrade in comparison to the Tm of the SCORP. In certain embodiments, the Tm content of the aforementioned distinct, second, or third polynucleotides is increased by at least about 2 or 3 to about 4, 5, or 6 degrees Centigrade in comparison to the Tm of the SCORP. In certain embodiments, the sCAI of the aforementioned distinct, second, or third polynucleotides is decreased by at least about 0.01, 0.02, 0.03, 0.04, or 0.05 in comparison to the sCAI of the SCORP. In certain embodiments, the sCAI is decreased by at least about 0.01 or 0.02 to about 0.03, 0.04, or 0.05 in comparison to the sCAI of the SCORP.

Non-limiting examples of soybean-directed subject synthetic polynucleotides provided herein and corresponding SCORP that encode certain RGE are set forth in Tables 1-12 below (and in the corresponding sequences of the listed SEQ ID NO of the Sequence Listing provided herewith). Also provided are synthetic polynucleotides encoding RGE, RGN, ndRGDBP polypeptides comprising one, two, three or more nucleotide insertions, deletions, and or substitutions in the synthetic polynucleotides set forth in Tables 1-12 below (and in the corresponding sequences of the listed SEQ ID NO of the Sequence Listing provided herewith).

TABLE 1

SpCas9 encoded protein, SCORP, and subject synthetic polynucleotides

| SEQ ID NO | TYPE | % ID to SEQ ID NO: 2 | % GC | Tm* | sCAI** |
|---|---|---|---|---|---|
| 1 | encoded SpCas9 protein | NA | NA | NA | NA |
| 2 | Artificial (SCORP) | 100 | 43.8 | 87.76 | 0.843 |
| 3 | Artificial | 76.779 | 51.3 | 90.92 | 0.82 |
| 4 | Artificial | 76.644 | 51.7 | 91.07 | 0.816 |
| 5 | Artificial | 77.802 | 52.3 | 91.36 | 0.814 |
| 6 | Artificial | 76.456 | 51.8 | 91.11 | 0.821 |
| 7 | Artificial | 76.717 | 51.7 | 91.01 | 0.821 |
| 8 | Artificial | 77.485 | 51.6 | 91.04 | 0.819 |
| 9 | Artificial | 76.869 | 51.7 | 91.1 | 0.816 |
| 10 | Artificial | 76.479 | 51.7 | 91.06 | 0.818 |
| 11 | Artificial | 76.023 | 51.2 | 90.88 | 0.822 |
| 12 | Artificial | 76.809 | 51.9 | 91.17 | 0.819 |

TABLE 2

SaCas9 encoded protein, SCORP, and subject synthetic polynucleotides

| SEQ ID NO | TYPE | % ID to SEQ ID NO: 14 | % GC | Tm* | sCAI** |
|---|---|---|---|---|---|
| 13 | Encoded SaCas9 protein | NA | NA | NA | NA |
| 14 | Artificial (SCORP) | 100 | 38.8 | 85.63 | 0.849 |
| 15 | Artificial | 75.925 | 49.1 | 90.05 | 0.826 |
| 16 | Artificial | 76.282 | 49 | 90 | 0.837 |
| 17 | Artificial | 77.327 | 49.4 | 90.12 | 0.83 |
| 18 | Artificial | 75.934 | 48.2 | 89.57 | 0.839 |
| 19 | Artificial | 75.966 | 48.6 | 89.76 | 0.83 |
| 20 | Artificial | 76.796 | 49.1 | 90 | 0.83 |
| 21 | Artificial | 76.575 | 48.8 | 89.85 | 0.832 |
| 22 | Artificial | 76.796 | 48.3 | 89.68 | 0.833 |
| 23 | Artificial | 76.716 | 48.2 | 89.64 | 0.837 |
| 24 | Artificial | 76.677 | 49.5 | 90.23 | 0.832 |

TABLE 3

FnCpf1 encoded protein, SCORP, and subject synthetic polynucleotides

| SEQ ID NO | TYPE | % ID to SEQ ID NO: 26 | % GC | Tm* | sCAI** |
|---|---|---|---|---|---|
| 25 | Encoded FnCpf1 protein | NA | NA | NA | NA |
| 26 | Artificial (SCORP) | 100 | 37 | 84.82 | 0.859 |
| 27 | Artificial | 75.789 | 48 | 89.59 | 0.831 |
| 28 | Artificial | 76.276 | 48.2 | 89.67 | 0.832 |
| 29 | Artificial | 76.116 | 48 | 89.62 | 0.829 |
| 30 | Artificial | 76.386 | 47.9 | 89.57 | 0.833 |
| 31 | Artificial | 76.538 | 47.9 | 89.54 | 0.833 |

TABLE 3-continued

FnCpf1 encoded protein, SCORP, and subject synthetic polynucleotides

| SEQ ID NO | TYPE | % ID to SEQ ID NO: 26 | % GC | Tm* | sCAI** |
|---|---|---|---|---|---|
| 32 | Artificial | 76.708 | 47.8 | 89.47 | 0.829 |
| 33 | Artificial | 76.386 | 48.3 | 89.7 | 0.827 |
| 34 | Artificial | 76.329 | 48.4 | 89.73 | 0.824 |
| 35 | Artificial | 76.371 | 48.6 | 89.84 | 0.831 |
| 36 | Artificial | 76.886 | 47.8 | 89.52 | 0.83 |

TABLE 4

CasJ encoded protein, SCORP, and subject synthetic polynucleotides

| SEQ ID NO | TYPE | % ID to SEQ ID NO: 38 | % GC | Tm* | sCAI** |
|---|---|---|---|---|---|
| 37 | Encoded CasJ protein | NA | NA | NA | NA |
| 38 | Artificial (SCORP) | 100 | 37.5 | 85.2 | 0.867 |
| 39 | Artificial | 77.385 | 48 | 89.53 | 0.839 |
| 40 | Artificial | 75.979 | 48.2 | 89.59 | 0.834 |
| 41 | Artificial | 77.007 | 47.7 | 89.38 | 0.839 |
| 42 | Artificial | 76.822 | 48.3 | 89.63 | 0.836 |
| 43 | Artificial | 76.931 | 48.9 | 89.93 | 0.834 |
| 44 | Artificial | 77.146 | 48.5 | 89.74 | 0.836 |
| 45 | Artificial | 77.247 | 47.9 | 89.42 | 0.838 |
| 46 | Artificial | 76.863 | 47.1 | 89.1 | 0.842 |
| 47 | Artificial | 76.319 | 48.2 | 89.61 | 0.835 |
| 48 | Artificial | 77.133 | 48.2 | 89.6 | 0.835 |

TABLE 5

AsCpf1 encoded protein, SCORP, and subject synthetic polynucleotides

| SEQ ID NO | TYPE | % ID to SEQ ID NO: 50 | % GC | Tm* | sCAI** |
|---|---|---|---|---|---|
| 49 | Encoded AsCpf1 protein | NA | NA | NA | NA |
| 50 | Artificial (SCORP) | 100 | 41 | 86.58 | 0.841 |
| 51 | Artificial | 75.874 | 52.8 | 91.62 | 0.821 |
| 52 | Artificial | 74.955 | 52.7 | 91.53 | 0.819 |
| 53 | Artificial | 75.542 | 52 | 91.28 | 0.819 |
| 54 | Artificial | 76.639 | 52 | 91.25 | 0.824 |
| 55 | Artificial | 75.746 | 52.2 | 91.36 | 0.816 |
| 56 | Artificial | 75.306 | 52.1 | 91.27 | 0.818 |
| 57 | Artificial | 75.618 | 52.6 | 91.52 | 0.82 |
| 58 | Artificial | 75.446 | 52.3 | 91.37 | 0.823 |
| 59 | Artificial | 76.217 | 52.1 | 91.25 | 0.823 |
| 60 | Artificial | 76.16 | 52 | 91.24 | 0.824 |

TABLE 6

Cms1 encoded protein, SCORP, and subject synthetic polynucleotides

| SEQ ID NO | TYPE | % ID to SEQ ID NO: 62 | % GC | Tm* | sCAI** |
|---|---|---|---|---|---|
| 61 | Encoded Cms1 protein | NA | NA | NA | NA |
| 62 | Artificial (SCORP) | 100 | 39.3 | 85.81 | 0.864 |
| 63 | Artificial | 76.675 | 49.7 | 90.24 | 0.834 |
| 64 | Artificial | 76.496 | 49.6 | 90.19 | 0.842 |
| 65 | Artificial | 76.786 | 49.2 | 89.97 | 0.846 |
| 66 | Artificial | 76.284 | 50 | 90.38 | 0.838 |
| 67 | Artificial | 76.423 | 48.8 | 89.9 | 0.841 |
| 68 | Artificial | 76.747 | 49.7 | 90.25 | 0.833 |
| 69 | Artificial | 76.089 | 49 | 89.94 | 0.843 |
| 70 | Artificial | 77.06 | 49.1 | 89.97 | 0.842 |
| 71 | Artificial | 77.207 | 48.8 | 89.88 | 0.845 |
| 72 | Artificial | 76.974 | 49.9 | 90.34 | 0.842 |

TABLE 7

LbCpf1 encoded protein, SCORP, and subject synthetic polynucleotides

| SEQ ID NO | TYPE | % ID to SEQ ID NO: 74 | % GC | Tm* | sCAI** |
|---|---|---|---|---|---|
| 73 | Encoded LbCpf1 protein | NA | NA | NA | NA |
| 74 | Artificial (SCORP) | 100 | 38.3 | 85.39 | 0.851 |
| 75 | Artificial | 76.614 | 48.8 | 89.88 | 0.829 |
| 76 | Artificial | 76.701 | 48.5 | 89.74 | 0.836 |
| 77 | Artificial | 77.021 | 48.4 | 89.73 | 0.834 |
| 78 | Artificial | 76.493 | 48.6 | 89.8 | 0.828 |
| 79 | Artificial | 77.113 | 48.3 | 89.69 | 0.836 |
| 80 | Artificial | 76.351 | 49 | 89.95 | 0.827 |
| 81 | Artificial | 77.265 | 48.2 | 89.61 | 0.836 |
| 82 | Artificial | 77.075 | 48.9 | 89.91 | 0.832 |
| 83 | Artificial | 76.533 | 48.6 | 89.75 | 0.834 |
| 84 | Artificial | 76.705 | 48.2 | 89.62 | 0.832 |

TABLE 8

MAD7 encoded protein, SCORP, and subject synthetic polynucleotides

| SEQ ID NO | TYPE | % ID to SEQ ID NO: 86 | % GC | Tm* | sCAI** |
|---|---|---|---|---|---|
| 85 | Encoded MAD7 protein | NA | NA | NA | NA |
| 86 | Artificial (SCORP) | 100 | 37.6 | 85.15 | 0.855 |
| 87 | Artificial | 76.558 | 47 | 89.21 | 0.83 |
| 88 | Artificial | 76.954 | 47.8 | 89.57 | 0.832 |
| 89 | Artificial | 76.548 | 48.1 | 89.72 | 0.824 |
| 90 | Artificial | 76.01 | 47.6 | 89.49 | 0.828 |
| 91 | Artificial | 75.619 | 47.4 | 89.41 | 0.836 |
| 92 | Artificial | 75.818 | 47.6 | 89.49 | 0.827 |
| 93 | Artificial | 76.246 | 47.3 | 89.32 | 0.828 |
| 94 | Artificial | 77.049 | 47.6 | 89.48 | 0.826 |
| 95 | Artificial | 76.3 | 48.1 | 89.66 | 0.83 |
| 96 | Artificial | 76.812 | 47.5 | 89.44 | 0.83 |

TABLE 9

CasX encoded protein, SCORP, and subject synthetic polynucleotides

| SEQ ID NO | TYPE | % ID to SEQ ID NO: 98 | % GC | Tm* | sCAI** |
|---|---|---|---|---|---|
| 97 | Encoded CasX protein | NA | NA | NA | NA |
| 98 | Artificial (SCORP) | 100 | 45.1 | 88.41 | 0.822 |
| 99 | Artificial | 76.809 | 54.6 | 92.39 | 0.821 |
| 100 | Artificial | 76.26 | 54.5 | 92.34 | 0.825 |
| 101 | Artificial | 76.158 | 55.9 | 92.98 | 0.808 |
| 102 | Artificial | 75.82 | 55 | 92.63 | 0.816 |
| 103 | Artificial | 75.786 | 54.3 | 92.3 | 0.817 |
| 104 | Artificial | 75.719 | 53.7 | 92.03 | 0.826 |
| 105 | Artificial | 75.583 | 55.3 | 92.71 | 0.807 |
| 106 | Artificial | 75.625 | 54.9 | 92.56 | 0.812 |
| 107 | Artificial | 75.6 | 55.4 | 92.78 | 0.809 |
| 108 | Artificial | 75.465 | 54.8 | 92.54 | 0.807 |

TABLE 10

Cas12j-1 encoded protein, SCORP, and subject synthetic polynucleotides

| SEQ ID NO | TYPE | % ID to SEQ ID NO: 121 | % GC | Tm* | sCAI** |
|---|---|---|---|---|---|
| 120 | encoded Cas12j-1 protein | NA | NA | NA | NA |
| 121 | Artificial (SCORP) | 100 | 46.4 | 88.94 | 0.83 |
| 122 | Artificial | 74.87 | 56.8 | 93.32 | 0.813 |
| 123 | Artificial | 74.96 | 56.5 | 93.18 | 0.812 |
| 124 | Artificial | 74.63 | 57.2 | 93.38 | 0.799 |
| 125 | Artificial | 76.43 | 56.0 | 92.92 | 0.795 |
| 126 | Artificial | 74.49 | 57 | 93.38 | 0.803 |
| 127 | Artificial | 74.68 | 57.5 | 93.59 | 0.804 |
| 128 | Artificial | 74.63 | 57.9 | 93.74 | 0.8 |
| 129 | Artificial | 74.92 | 57.3 | 93.5 | 0.802 |
| 130 | Artificial | 75.06 | 57.1 | 93.46 | 0.81 |
| 131 | Artificial | 73.27 | 57 | 93.36 | 0.81 |

TABLE 11

Cas12j-2 encoded protein, SCORP, and subject synthetic polynucleotides

| SEQ ID NO | TYPE | % ID to SEQ ID NO: 133 | % GC | Tm* | sCAI** |
|---|---|---|---|---|---|
| 132 | Encoded Cas12j-2 protein | NA | NA | NA | NA |
| 133 | Artificial (SCORP) | 100 | 48.7 | 89.92 | 0.836 |
| 134 | Artificial | 74.81 | 57.8 | 93.72 | 0.809 |
| 135 | Artificial | 75.17 | 59.1 | 94.26 | 0.801 |
| 136 | Artificial | 74.94 | 58.3 | 93.9 | 0.804 |
| 137 | Artificial | 74.37 | 58.4 | 93.88 | 0.799 |
| 138 | Artificial | 75.47 | 58.5 | 94.01 | 0.802 |
| 139 | Artificial | 75.91 | 56.8 | 93.25 | 0.799 |
| 140 | Artificial | 74.99 | 59 | 94.16 | 0.803 |
| 141 | Artificial | 75.61 | 58.3 | 94 | 0.809 |
| 142 | Artificial | 74.72 | 58.6 | 94 | 0.802 |
| 143 | Artificial | 75.21 | 59.3 | 94.37 | 0.801 |

TABLE 12

Cas12j-3 encoded protein, SCORP, and subject synthetic polynucleotides.

| SEQ ID NO | TYPE | % ID to SEQ ID NO: 145 | % GC | Tm* | sCAI** |
|---|---|---|---|---|---|
| 144 | Encoded Cas12j-3 protein | NA | NA | NA | NA |
| 145 | Artificial (SCORP) | 100 | 43 | 87.45 | 0.838 |
| 146 | Artificial | 75.2 | 52.6 | 91.54 | 0.810 |
| 147 | Artificial | 74.98 | 53.3 | 91.85 | 0.808 |
| 148 | Artificial | 74.19 | 52.0 | 91.3 | 0.820 |
| 149 | Artificial | 75.94 | 50.7 | 90.70 | 0.804 |
| 150 | Artificial | 74.24 | 53.2 | 91.78 | 0.810 |
| 151 | Artificial | 74.93 | 52.0 | 91.31 | 0.809 |
| 152 | Artificial | 75.11 | 52.0 | 91.38 | 0.820 |
| 153 | Artificial | 75.67 | 52.3 | 91.4 | 0.815 |
| 154 | Artificial | 74.98 | 52.1 | 91.29 | 0.818 |
| 155 | Artificial | 76.2 | 52.9 | 91.71 | 0.814 |

*Tm calculated according to the method of Khandelwal G, Bhyravabhotla J (2010) PLoS ONE 5(8): e12433. doi.org/10.1371/journal.pone.0012433, where Conc = [Na+] concentration of the solution (Molar) = 0.16M; and DNA = total nucleotide strand concentration = 0.0001 g/mL.
**The sCAI is calculated from the program on the http: internet site "genomes.urv.es/CAIcal/" (Puigbo et al. Biology Direct, 3: 38) using the soybean codon bias table of FIG. 1.

* Tm calculated according to the method of Khandelwal G, Bhyravabhotla J (2010) PLoS ONE 5(8): e12433. doi.org/10.1371/journal.pone.0012433, where Conc= [Na+] concentration of the solution (Molar)=0.16M; and DNA=total nucleotide strand concentration=0.0001 g/mL.

** The sCAI is calculated from the program on the http: internet site "genomes.urv.es/CAIcal/" (Puigbo et al. Biology Direct, 3:38) using the soybean codon bias table of FIG. 1.

SEQ ID NO: 156-165, 166-175, and 176-185 represent nucleic acid sequences optimized for monocot expression, such as corn-optimized nucleic acid sequences encoding Cas12j-1, Cas12j-2, and Cas12j-3, respectively.

A subject synthetic polynucleotide and SCORP can encode an RGE, RGN, or ndRGDBP polypeptide (this term is used interchangeably with the term "RGE, RGN, or ndRGDBP protein") which can bind and/or modify (e.g., cleave, nick, methylate, demethylate, etc.) a target nucleic acid and/or a polypeptide associated with target nucleic acid (e.g., methylation or acetylation of a histone tail) (e.g., in some cases the RGE, RGN, or ndRGDBP protein includes a fusion partner with an activity, and in some cases the RGE or RGN provides nuclease activity). In some cases, the RGE protein is a naturally-occurring protein (e.g., naturally-occurs in prokaryotic cells). In other cases, the RGE, RGN, or ndRGDBP protein is not a naturally-occurring polypeptide (e.g., the RGE, RGN, or ndRGDBP protein is a variant RGE, RGN, or ndRGDBP protein, a chimeric protein, an RGE, RGN, or ndRGDBP fusion polypeptide, and the like).

In some embodiments, the RGE protein encoded by the subject synthetic polynucleotide and SCORP can encode a naturally-occurring (wild type) protein. Non-limiting examples of sequences of naturally-occurring RGE proteins are set forth in SEQ ID NO: 1, 13, 25, 37, 49, 61, 73, 85, 97, 120, 132, and 144. However, the subject synthetic polynucleotide and SCORP are non-naturally occurring (artificial) polynucleotides. In certain embodiments, an RGE protein encoded by a subject synthetic polynucleotide and SCORP is a non-naturally occurring polypeptide comprising one or more insertions, deletions, and/or substitutions of amino acid residues in comparison to the naturally occurring RGE protein. In certain embodiments, a RGN or ndRGDBP protein encoded by a subject synthetic polynucleotide and SCORP is a non-naturally occurring polypeptide comprising one or more insertions, deletions, and/or substitutions of amino acid residues in comparison to the naturally occurring RGE protein.

In some embodiments, the synthetic polynucleotide has at least 70%, 76%, 80%, 85%, 90%, 95%, 97%, 98%, 99%, or 100% sequence identity across the entire length of any one of: (i) at least one, two, three, four, five, six, seven, eight, nine, or ten polynucleotides selected from the group consisting of SEQ ID NO: 3-12, and optionally a sCAI that is lower than the sCAI of the soybean codon optimized reference polynucleotide of SEQ ID NO: 2 and/or a GC (guanine and cytosine) content greater than 47 or 48%; (ii) at least one, two, three, four, five, six, seven, eight, nine, or ten polynucleotides selected from the group consisting of SEQ ID NO: 15-24, and optionally a sCAI that is lower than the sCAI of the soybean codon optimized reference polynucleotide of SEQ ID NO: 14 and/or a GC (guanine and cytosine) content greater than 47 or 48%; (iii) at least one, two, three, four, five, six, seven, eight, nine, or ten polynucleotides selected from the group consisting of SEQ ID NO: 27-36, and optionally a sCAI that is lower than the sCAI of the soybean codon optimized reference polynucleotide of SEQ ID NO: 26 and/or a GC (guanine and cytosine) content greater than 47 or 48%; (iv) at least one, two, three, four, five, six, seven, eight, nine, or ten polynucleotides selected from the group consisting of SEQ ID NO: 39-48, and optionally a sCAI that is lower than the sCAI of the soybean codon optimized reference polynucleotide of SEQ ID NO: 38 and/or a GC (guanine and cytosine) content greater than 47 or 48%; (v) at least one, two, three, four, five, six, seven, eight, nine, or ten polynucleotides selected from the group consisting of SEQ ID NO: 51-60, and optionally a sCAI that is lower than the sCAI of the soybean codon optimized reference polynucleotide of SEQ ID NO: 50 and/or a GC (guanine and cytosine) content greater than 47 or 48%; (vi) at least one, two, three, four, five, six, seven, eight, nine, or ten polynucleotides selected from the group consisting of SEQ ID NO: 63-72, and optionally a sCAI that is lower than the sCAI of the soybean codon optimized reference polynucleotide of SEQ ID NO: 62 and/or a GC (guanine and cytosine) content greater than 47 or 48%; (vii) at least one, two, three, four, five, six, seven, eight, nine, or ten polynucleotides selected from the group consisting of SEQ ID NO: 75-84, and optionally a sCAI that is lower than the sCAI of the soybean codon optimized reference polynucleotide of SEQ ID NO: 74 and/or a GC (guanine and cytosine) content greater than 47 or 48%; (viii) at least one, two, three, four, five, six, seven, eight, nine, or ten polynucleotides selected from the group consisting of SEQ ID NO: 87-96 and optionally a sCAI that is lower than the sCAI of the soybean codon optimized reference polynucleotide of SEQ ID NO: 86 and/or a GC (guanine and cytosine) content greater than 47 or 48%; (ix) at least one, two, three, four, five, six, seven, eight, nine, or ten polynucleotides selected from the group consisting of SEQ ID NO: 99-108 and optionally a sCAI that is lower than the sCAI of the soybean codon optimized reference polynucleotide of SEQ ID NO: 98 and/or a GC (guanine and cytosine) content greater than 47 or 48%; (x) at least one, two, three, four, five, six, seven, eight, nine, or ten polynucleotides selected from the group consisting of SEQ ID NO: 122-131, and optionally an sCAI that is lower than the sCAI of the soybean codon optimized reference polynucleotide of SEQ ID NO: 121 and/or a GC (guanine and cytosine) content greater than 50%, e.g. greater than 55, 56, 57, or 58%; (xi) at least one, two, three, four, five, six, seven, eight, nine, or ten polynucleotides selected from the group consisting of SEQ ID NO: 134-143, and optionally a sCAI that is lower than the sCAI of the soybean codon optimized reference polynucleotide of SEQ ID NO: 133 and/or a GC (guanine and cytosine) content greater than 50%, e.g. greater than 56, 57, 58, 59, or 60%; (xii) at least one, two, three, four, five, six, seven, eight, nine, or ten polynucleotides selected from the group consisting of SEQ ID NO: 146-154, and 155, and optionally a sCAI that is lower than the sCAI of the soybean codon optimized reference polynucleotide of SEQ ID NO: 145 and/or a GC (guanine and cytosine) content greater than 45%, e.g. greater than 50, 51, 52, 53, or 54%.

In some cases, an RGE, RGN, or ndRGDBP protein encoded by a subject synthetic polynucleotide and SCORP encodes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the RGE, RGN, or ndRGDBP protein sequence set forth as SEQ ID NO: 1, 13, 25, 37, 49, 61, 73, 85, 97, 120, 132, or 144, where proteins having 100% sequence identity to SEQ ID NO: 1, 13, 25, 37, 49, 61, 73, 85, 97, 120, 132, or 144 are RGEs. For example, in some cases, an RGE, RGN, or ndRGDBP protein encodes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the RGE, RGN, or ndRGDBP protein sequence set forth as SEQ ID NO: 1, 13, 25, 37, 49, 61, 73, 85, or 97, where proteins having 100% sequence identity to SEQ ID NO: 1, 13, 25, 37, 49, 61, 73, 85, 97, 120, 132, or 144 are RGEs. In some cases, an RGE, RGN, or ndRGDBP protein encodes an amino acid sequence having 80% or more sequence identity (e.g., 85% or more, 90% or more, 95% or more, 97% or more, 98% or more, 99% or more, or 100% sequence identity) with the RGE, RGN, or ndRGDBP protein sequence set forth as SEQ ID NO: 1, 13, 25, 37, 49, 61, 73, 85, 97, 120, 132, or 144 where proteins having 100% sequence identity to SEQ ID NO: 1, 13, 25, 37, 49, 61, 73, 85, 97, 120, 132, or 144 are RGEs. In some cases, an RGE, RGN, or ndRGDBP protein encodes an amino acid sequence having 90% or more sequence identity (e.g., 95% or more, 97% or more, 98% or more, 99% or more, 99.5%, 99.8%, 99.9%, or 100% sequence identity) with the RGE, RGN, or ndRGDBP protein sequence set forth as SEQ ID NO: 1, 13, 25, 37, 49, 61, 73, 85, 97, 120, 132, or 144, where proteins having 100% sequence identity to SEQ ID NO: 1, 13, 25, 37, 49, 61, 73, 85, 97, 120, 132, or 144, are RGEs. In some cases, an RGE, RGN, or ndRGDBP protein encodes an amino acid sequence having the RGE, RGN, or ndRGDBP protein sequence set forth as SEQ ID NO: 1, 13, 25, 37, 49, 61, 73, 85, 97, 120, 132, or 144. In some cases, an RGE, RGN, or ndRGDBP protein encodes an amino acid sequence having the RGE, RGN, or ndRGDBP protein sequence set forth as SEQ ID NO: 1, 13, 25, 37, 49, 61, 73, 85, 97, 120, 132, or 144, with the exception that the sequence encodes an amino acid substitution (e.g., 1, 2, 3, or more amino acid substitutions) that reduces the naturally-occurring catalytic activity of the protein (e.g., such as at amino acid positions described below). An RGE, RGN, or ndRGDBP fusion polypeptide which further comprises additional heterologous peptide sequences can further comprise any of the aforementioned RGE, RGN, or ndRGDBP proteins.

An RGE protein includes 3 partial RuvC domains (RuvC-I, RuvC-II, and RuvC-III, also referred to herein as subdomains) that are not contiguous with respect to the primary amino acid sequence of the RGE protein but form a RuvC domain once the protein is produced and folds. In some cases, an RGE protein (of the subject compositions and/or methods) includes a split RuvC domain (e.g., 3 partial RuvC domains—RuvC-I, RuvC-II, and RuvC-III).

A variant RGE, RGN, or ndRGDBP protein has an amino acid sequence that is different by at least one amino acid (e.g., has a deletion, insertion, substitution, fusion) when compared to the amino acid sequence of the corresponding wild type RGE protein. An RGN protein that cleaves one strand but not the other of a double stranded target nucleic acid is referred to herein as an "RGN" or "nickase" (e.g., a "nickase CasJ"). A Cas protein that has substantially no nuclease activity is referred to herein as a ndRGDBP or dead Cas protein ("dCas") (with the caveat that in certain embodiments nuclease activity can be provided by a heterologous polypeptide which is operably linked to the ndRGDBP). For any of the RGE, RGN, or ndRGDBP variant proteins described herein (e.g., nickase Cas, dCas, chimeric Cas, Cas fusion polypeptide), the RGE, RGN, or ndRGDBP variant can include an RGE, RGN, or ndRGDBP protein sequence with the same parameters described above (e.g., domains that are present, percent identity, and the like).

In certain embodiments, the encoded ndRGDBP is obtained from an RGE, e.g., mutated relative to the naturally-occurring catalytically active RGE sequence, and exhibits reduced endonuclease activity (e.g., exhibits 90%, or less, 80% or less, 70% or less, 60% or less, 50% or less, 40% or less, 30% or less, 20% or less, 10% or less, 5% or less, or 1% or less endonuclease activity) when compared to the corresponding naturally-occurring sequence. In some cases, the encoded ndRGDBP is a catalytically 'dead' protein (has substantially no endonuclease activity) and can be referred to as a 'dCas.' In some cases, the encoded RGN cleaves only one strand of a double stranded target nucleic acid, e.g., a double stranded target DNA). As described in more detail herein, in some cases, an encoded RGE, RGN, or ndRGDBP is fused (e.g., conjugated or operably linked) to a heterologous polypeptide that has an activity of interest (e.g., a catalytic activity of interest) to form a fusion protein (e.g., a chimeric Cas protein or a Cas fusion polypeptide).

Conserved catalytic residues of a Cas9 RGE (SEQ ID NO: 1) include the RuvC subdomain residues identified above. D10 and/or H840, numbered according to SEQ ID NO: 1, are residues that can be mutated, for example as D10A or H840A, to decrease the catalytic activity of a Cas9 polypeptide and provide a ndRGDBP. Thus, in some cases, the Cas9 protein has reduced activity when one or more of the above described amino acids (or one or more corresponding amino acids of any Cas9 protein) are mutated (e.g., substituted with an alanine). In some cases, the variant Cas9 protein is a catalytically 'dead' protein (is catalytically inactive) and is referred to as 'dCas9.' A dCas9 protein can be fused to a fusion partner that provides an activity, and in some cases, the dCas9 (e.g., one without a fusion partner that provides catalytic activity—but which can have an NLS when expressed in a eukaryotic cell) can bind to target DNA and can block RNA polymerase from translating from a target DNA or the function of other endogenous DNA binding or processing proteins. In some cases, a nickase or RGN which cleaves only one strand of a double stranded target nucleic acid, (e.g., a double stranded target DNA) can be obtained by mutating one or more residues and/or catalytic residues of a Cas9 protein of SEQ ID NO: 1. In certain embodiments, the Cas9 RGN can comprise mutations in residue D10 (e.g., D10A). A Cas9 fusion polypeptide can comprise any of the aforementioned Cas9 RGE, ndDBP, or RGN proteins and a heterologous polypeptide.

Conserved catalytic residues of a FnCpf1 RGE (SEQ ID NO: 25) include the RuvC subdomain residues identified above. D917, E1006, E1028, D1255, and/or N1257, numbered according to SEQ ID NO: 25, are residues that can be mutated, for example as D917A, E1006A, E1028A, D1255A, and/or N1257A, to decrease the catalytic activity of a FnCpf1 polypeptide and provide a ndRGDBP. Thus, in some cases, the FnCpf1 protein has reduced activity when one or more of the above described amino acids (or one or more corresponding amino acids of any FnCpf1 protein) are mutated (e.g., substituted with an alanine). In some cases, the variant FnCpf1 protein is a catalytically 'dead' protein (is catalytically inactive) and is referred to as 'dFnCpf1.' A dFnCpf1 protein can be fused to a fusion partner that provides an activity, and in some cases, the dFnCpf1 (e.g., one without a fusion partner that provides catalytic activity—but which can have an NLS when expressed in a eukaryotic cell) can bind to target DNA and can block RNA polymerase from translating from a target DNA or the function of other endogenous DNA binding or processing proteins. In some cases, a nickase or RGN which cleaves only one strand of a double stranded target nucleic acid, (e.g., a double stranded target DNA) can be obtained by mutating one or more residues and/or catalytic residues of a FnCpf1 protein of SEQ ID NO: 25. In certain embodiments, the FnCpf1 RGN can comprise mutations in residue R1226 (e.g., R1226A). A FnCpf1 fusion polypeptide can comprise any of the aforementioned FnCpf1 RGE, ndDBP, or RGN proteins and a heterologous polypeptide.

Conserved catalytic residues of a CasJ RGE (SEQ ID NO: 37) include the RuvC subdomain residues identified above. D901, E1128 and D1298, numbered according to SEQ ID NO: 37, are residues that can be mutated, for example as D901A, E1128A, or D1298A, to decrease the catalytic activity of a CasJ polypeptide and provide a ndRGDBP. Thus, in some cases, the CasJ protein has reduced activity when one or more of the above described amino acids (or one or more corresponding amino acids of any CasJ protein) are mutated (e.g., substituted with an alanine). In some cases, the variant CasJ protein is a catalytically 'dead' protein (is catalytically inactive) and is referred to as 'dCasJ.' A dCasJ protein can be fused to a fusion partner that provides an activity, and in some cases, the dCasJ (e.g., one without a fusion partner that provides catalytic activity—but which can have an NLS when expressed in a eukaryotic cell) can bind to target DNA and can block RNA polymerase from translating from a target DNA or the function of other endogenous DNA binding or processing proteins. In some cases, a nickase or RGN which cleaves only one strand of a double stranded target nucleic acid, (e.g., a double stranded target DNA) can be obtained by mutating one or more residues and/or catalytic residues of a CasJ protein of SEQ ID NO: 37. In certain embodiments, the CasJ RGN can comprise mutations in residues E1128 and/or D1298 (e.g., E1128A and/or D1298A). A CasJ fusion polypeptide can comprise any of the aforementioned CasJ RGE, ndDBP, or RGN proteins and a heterologous polypeptide.

Conserved catalytic residues of a LbCpf1 RGE (SEQ ID NO: 73) include the RuvC subdomain residues identified above. D832, E925, and/or D1148, numbered according to SEQ ID NO: 73, are residues that can be mutated, for example as D832A, E925A, and/or D1148A, to decrease the catalytic activity of a LbCpf1 polypeptide and provide a ndRGDBP. Thus, in some cases, the LbCpf1 protein has reduced activity when one or more of the above described amino acids (or one or more corresponding amino acids of any LbCpf1 protein) are mutated (e.g., substituted with an alanine). In some cases, the variant LbCpf1 protein is a catalytically 'dead' protein (is catalytically inactive) and is referred to as 'dLbCpf1.' A dLbCpf1 protein can be fused to a fusion partner that provides an activity, and in some cases, the dLbCpf1 (e.g., one without a fusion partner that provides catalytic activity—but which can have an NLS when expressed in a eukaryotic cell) can bind to target DNA and can block RNA polymerase from translating from a target DNA or the function of other endogenous DNA binding or processing proteins. In some cases, a nickase or RGN which cleaves only one strand of a double stranded target nucleic acid, (e.g., a double stranded target DNA) can be obtained by mutating one or more residues and/or catalytic residues of a LbCpf1 protein of SEQ ID NO: 73. In certain embodiments, the LbCpf1 RGN can comprise mutations in residue R1138 (e.g., R1138A). A LbCpf1 fusion polypeptide can comprise any of the aforementioned LbCpf1 RGE, ndDBP, or RGN proteins and a heterologous polypeptide.

Conserved catalytic residues of a Cas12j-1 RGE (SEQ ID NO: 120) include RuvC subdomain residues. D371, E579, and/or D673, numbered according to SEQ ID NO: 120, are residues that can be mutated. C640, C643, C646, C661, and/or C664 can also be mutated to decrease the catalytic activity. Exemplary mutations are D371A, E579A, D673A, C640A, C643A, C646A, C661A, C664A, C640S, C643S, C646S, C661S, and C664S, to decrease the catalytic activity of a Cas12j-1 polypeptide and provide an ndRGDBP. Thus, in some cases, Cas12j-1 protein has reduced activity when one or more of the above described amino acids (or one or more corresponding amino acids of any Cas12j-1 protein) are mutated (e.g., substituted with an alanine or serine). In some cases, the variant Cas12j-1 protein is a catalytically 'dead' protein (is catalytically inactive) and is referred to as 'dCas12j-1.' A dCas12j-1 protein can be fused to a fusion partner that provides an activity, and in some cases, the d Cas12j-1 (e.g., one without a fusion partner that provides catalytic activity—but which can have an NLS when expressed in a eukaryotic cell) can bind to target DNA and can block RNA polymerase from translating from a target DNA or the function of other endogenous DNA binding or processing proteins. A Cas12j-1 fusion polypeptide can comprise any of the aforementioned Cas12j-1 RGE or ndDBP proteins and a heterologous polypeptide.

Conserved catalytic residues of a Cas12j-2 RGE (SEQ ID NO: 132) include RuvC subdomain residues identified above. D394, E606, and/or D697, numbered according to SEQ ID NO: 132, are residues that can be mutated. C667, C670, C673, C685, and C688 can also be mutated to decrease the catalytic activity. Exemplary mutations are D394A, E606A, D697A, C667A, C670A, C673A, C685A, C688A, C667S, C670S, C673S, C685S, and C688S, to decrease the catalytic activity of a Cas12j-2 polypeptide and provide a ndRGDBP. Thus, in some cases, the Cas12j-2 protein has reduced activity when one or more of the above described amino acids (or one or more corresponding amino acids of any Cas12j-2 protein) are mutated (e.g., substituted with an alanine or serine). In some cases, the variant Cas12j-2 protein is a catalytically 'dead' protein (is catalytically inactive) and is referred to as 'dCas12j-2.' A dCas12j-2 protein can be fused to a fusion partner that provides an activity, and in some cases, the dCas12j-2 (e.g., one without a fusion partner that provides catalytic activity—but which can have an NLS when expressed in a eukaryotic cell) can bind to target DNA and can block RNA polymerase from translating from a target DNA or the function of other endogenous DNA binding or processing proteins. A Cas12j-2 fusion polypeptide can comprise any of the aforementioned Cas12j-2 RGE or ndDBP proteins and a heterologous polypeptide.

Conserved catalytic residues of a Cas12j-3 RGE (SEQ ID NO: 144) include RuvC subdomain residues. D413, E618, and/or D710, numbered according to SEQ ID NO: 144, are residues that can be mutated. C680, C683, C687, C698, and C701 can also be mutated to decrease the catalytic activity. Exemplary mutations are D413A, E618A, D710A, C680A, C683A, C687A, C698A, C701A, C680S, C683S, C687S, C698S, and C701S, to decrease the catalytic activity of a Cas12j-3 polypeptide and provide a ndRGDBP. Thus, in some cases, the Cas12j-3 protein has reduced activity when one or more of the above described amino acids (or one or more corresponding amino acids of any Cas12j-3 protein) are mutated (e.g., substituted with an alanine or serine). In some cases, the variant Cas12j-3 protein is a catalytically 'dead' protein (is catalytically inactive) and is referred to as 'dCas12j-3.' A dCas12j-3 protein can be fused to a fusion partner that provides an activity, and in some cases, the dCas12j-3 (e.g., one without a fusion partner that provides catalytic activity—but which can have an NLS when expressed in a eukaryotic cell) can bind to target DNA and can block RNA polymerase from translating from a target DNA or the function of other endogenous DNA binding or processing proteins. A Cas12j-3 fusion polypeptide can comprise any of the aforementioned Cas12j-3 RGE or ndDBP proteins and a heterologous polypeptide.

As noted above, in some cases, an RGE, RGN, or ndRGDBP protein (in some cases a Cas9, Cas12a, Cas12e, or Cas12j protein with wild type endonuclease activity and in some cases a variant RGE, RGN, or ndRGDBP with reduced or modified cleavage activity, e.g., a dCas or a nickase Cas) is fused (conjugated) to a heterologous polypeptide that has an activity of interest (e.g., a catalytic activity of interest) to form a fusion protein (e.g., a chimeric Cas or Cpf1 protein or a Cas or Cpf1 fusion polypeptide). A heterologous polypeptide to which an RGE, RGN, or ndRGDBP Cas protein can be fused is referred to herein as a 'fusion partner.' In certain embodiments, subject polynucleotides encoding the RGE, RGN, or ndRGDBP are operably linked to polynucleotides encoding the heterologous polypeptides or fusion partners. In certain embodiments, the polynucleotides encoding the heterologous polypeptides or fusion partners have: (i) a GC (guanine and cytosine) content greater than 47, 48%, or 50%; (ii) a melting temperature (Tm) greater than 89 or 90 degrees Celsius; (iii) a soybean codon adaptation index (sCAI) which is lower than the sCAI of a second soybean codon-optimized reference polynucleotide encoding the heterologous polypeptide; or any combination of (i), (ii), and (iii). Heterologous polypeptides fused to RGE, RGN, or ndRGDBP encoded by subject polynucleotides include a heterologous polypeptide having an enzymatic activity that modifies target DNA, a nuclear localization signal (NLS), a chloroplast transit peptide (CTP), an epitope tag (ST), a transcriptional activation domain (TAD), a transcriptional repressor domain (TRD); or any combination thereof.

In some cases, the fusion partner (e.g., heterologous polypeptide) can modulate transcription (e.g., inhibit transcription, increase transcription) of a target DNA when fused, for example, to a ndRGDBP encoded by a subject synthetic polynucleotide or SCORP. For example, in some cases the fusion partner is a protein (or a domain from a protein) that inhibits transcription (e.g., a transcriptional repressor, a protein that functions via recruitment of transcription inhibitor proteins, modification of target DNA such as methylation, recruitment of a DNA modifier, modulation of histones associated with target DNA, recruitment of a histone modifier such as those that modify acetylation and/or methylation of histones, and the like). In some cases, the fusion partner is a protein (or a domain from a protein) that increases transcription (e.g., a transcription activator, a protein that acts via recruitment of transcription activator proteins, modification of target DNA such as demethylation, recruitment of a DNA modifier, modulation of histones associated with target DNA, recruitment of a histone modifier such as those that modify acetylation and/or methylation of histones, and the like).

In some cases, a chimeric RGE, RGN, or ndRGDBP protein or RGE, RGN, or ndRGDBP fusion polypeptide includes a heterologous polypeptide that has enzymatic activity that modifies a target nucleic acid (e.g., nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity or glycosylase activity).

In some cases, a chimeric RGE, RGN, or ndRGDBP protein or RGE, RGN, or ndRGDBP fusion polypeptide includes a heterologous polypeptide that has enzymatic activity that modifies a polypeptide (e.g., a histone) associated with a target nucleic acid (e.g., methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity or demyristoylation activity).

Examples of heterologous polypeptides that can be used in increase transcription of a target endogenous gene can comprise transcriptional activator domains (TAD) such as maize c1VP16, VP64, VP48, VP160, p65 subdomain (e.g., fromNFkB), a TAD of EDLL and/or TAL activation domain (e.g., for activity in plants); histone lysine methyltransferases such as SET1A, SET1B, MLL1 to 5, ASH1, SYMD2, NSDl, and the like; histone lysine demethylases such as JHDM2a/b, UTX, JMJD3, and the like; histone acetyltransferases such as GCN5, PCAF, CBP, p300, TAF1, TIP60/PLIP, MOZ/MYST3, MORF/MYST4, SRCl, ACTR, P160, CLOCK, and the like; and DNA demethylases such as Ten-Eleven Translocation (TET) dioxygenase 1 (TET1CD), TET1, DME, DML1, DML2, ROS1, and the like. In certain embodiments, multiple VP64 TADs can be used (Lowder et al., Mol Plant. 2018; 11(2):245-256). Another example of a potent plant TAD that can be used in the ATFs provided herein is the EDLL motif that is found in AP2/ERF transcription factors (Tiwari et al., Plant J. 2012; 70(5):855-65). Yet another example of a potent plant TAD that can be used in the ATFs provided herein is a hybrid VP64-p65-Rta tripartite activator (VPR; SEQ ID NO: 109; Chavez et al., Nat Methods. 2015; 12(4):326-8). In certain embodiments, the aforementioned heterologous peptides can be fused to a ndRGDBP which binds to the target endogenous gene. In certain embodiments, such ndRDBP can also be fused to a suitable targeting peptide such as a nuclear localization signal (NLS; when a nuclear gene is targeted) or a chloroplast transit peptide (CTP; when a gene in a plastid genome is targeted).

Examples of heterologous polypeptides that can be used to decrease transcription can comprise transcriptional repressor domains (TRDs) including the Kruppel associated box (KRAB or SKD); KOX1 repression domain; the Mad mSIN3 interaction domain (SID); the ERF repressor domain (ERD; Dong C J, Liu J Y. BMC Plant Biol. 2010 Mar. 16; 10:47.) or the SRDX repression domain (Figueroa P, Browse J. Plant J. 2015 March; 81(6):849-60) for repression in plants, and the like; histone lysine methyltransferases such as Pr-SET7/8, SUV4-20H1, RIZl, and the like; histone lysine demethylases such as JMJD2A/JHDM3A, JMJD2B, JMJD2C/GASC1, JMJD2D, JARID1A/RBP2, JARID1B/PLU-1, JARID1C/SMCX, JARID1D/SMCY, and the like; histone lysine deacetylases such as HDAC1, HDAC2, HDAC3, HDAC8, HDAC4, HDAC5, HDAC7, HDAC9, SIRT1, SIRT2, HDAC11, and the like; DNA methylases such as Hhal DNA m5c-methyltransferase (M.Hhal), DNA methyltransferase 1 (DNMT1), DNA methyltransferase 3a (DNMT3a), DNA methyltransferase 3b (DNMT3b), MET1, DRM3 (plants), ZMET2, CMT1, CMT2 (plants), and the like; and periphery recruitment elements such as Lamin A, Lamin B, and the like. In certain embodiments, the aforementioned heterologous peptides can be fused to a ndRGDBP which binds to the target endogenous gene. In certain embodiments, such ndRDBP can also be fused to a suitable targeting peptide such as a nuclear localization signal (NLS; when a nuclear gene is targeted) or a chloroplast transit peptide (CTP; when a gene in a plastid genome is targeted).

In some cases, the fusion partner used in an RGE, RGN, or ndRGDBP fusion polypeptide has enzymatic activity that modifies the target nucleic acid (e.g., ssRNA, dsRNA, ssDNA, dsDNA). Examples of enzymatic activity that can be provided by the fusion partner include but are not limited to: nuclease activity such as that provided by a restriction enzyme (e.g., Fokl nuclease), methyltransferase activity such as that provided by a methyltransferase (e.g., Hhal DNA m5c-methyltransferase, M.Hhal), DNA methyltransferase 1 (DNMT1), DNA methyltransferase 3a (DNMT3a), DNA methyltransferase 3b (DNMT3b), MET1, DRM3 (plants), ZMET2, CMT1, CMT2 (plants), and the like); demethylase activity such as that provided by a demethylase (e.g., Ten-Eleven Translocation (TET) dioxygenase 1 (TET1CD), TET1, DME, DML1, DML2, ROS 1, and the like), DNA repair activity, DNA damage activity, deamination activity such as that provided by a deaminase (e.g., a cytosine deaminase enzyme such as rat APOBEC1), dismutase activity, alkylation activity, depurination activity, oxidation activity, pyrimidine dimer forming activity, integrase activity such as that provided by an integrase and/or resolvase (e.g., Gin invertase such as the hyperactive mutant of the Gin invertase, GinH106Y; human immunodeficiency virus type 1 integrase (IN); Tn3 resolvase; and the like), transposase activity, recombinase activity such as that provided by a recombinase (e.g., catalytic domain of Gin recombinase), polymerase activity, ligase activity, helicase activity, photolyase activity, and glycosylase activity).

In some cases, the fusion partner used in an RGE, RGN, or ndRGDBP fusion polypeptide has enzymatic activity that modifies a protein associated with the target nucleic acid (e.g., ssRNA, dsRNA, ssDNA, dsDNA) (e.g., a histone, an RNA binding protein, a DNA binding protein, and the like). Examples of enzymatic activity (that modifies a protein associated with a target nucleic acid) that can be provided by the fusion partner include but are not limited to: methyltransferase activity such as that provided by a histone methyltransferase (HMT) (e.g., suppressor of variegation 3-9 homolog 1 (SUV39H1, also known as KMTIA), euchromatic histone lysine methyltransferase 2 (G9A, also known as KMT1C and EHMT2), SUV39H2, ESET/SETDB 1, and the like, SET1A, SET1B, MLL1 to 5, ASH1, SYMD2, NSD1, DOT1L, Pr-SET7/8, SUV4-20H1, EZH2, RIZ1), demethylase activity such as that provided by a histone demethylase (e.g., Lysine Demethylase 1A (KDM1A also known as LSD1), JHDM2a/b, JMJD2A/JHDM3A, JMJD2B, JMJD2C/GASC1, JMJD2D, JARID1A/RBP2, JARIDIB/PLU-1, JARID1C/SMCX, JARID1D/SMCY, UTX, JMJD3, and the like), acetyltransferase activity such as that provided by a histone acetylase transferase (e.g., catalytic core/fragment of the human acetyltransferase p300, GCN5, PCAF, CBP, TAF1, TIP60/PLIP, MOZ/MYST3, MORF/MYST4, HBO1/MYST2, HMOF/MYST1, SRC1, ACTR, P160, CLOCK, and the like), deacetylase activity such as that provided by a histone deacetylase (e.g., HDAC1, HDAC2, HDAC3, HDAC8, HDAC4, HDAC5, HDAC7, HDAC9, SIRT1, SIRT2, HDAC11, and the like), kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity, and demyristoylation activity.

An additional examples of a suitable fusion partners used in an RGE, RGN, or ndRGDBP fusion polypeptide are dihydrofolate reductase (DHFR) destabilization domain (e.g., to generate a chemically controllable chimeric RGE, RGN, or ndRGDBP protein or RGE, RGN, or ndRGDBP fusion polypeptide), and a chloroplast transit peptide.

In some case, an RGE, RGN, or ndRGDBP fusion polypeptide comprises: a) an RGE, RGN, or ndRGDBP polypeptide; and b) a chloroplast transit peptide. Thus, for example, a CRISPR-RGE, RGN, or ndRGDBP complex can be targeted to the chloroplast. In some cases, this targeting may be achieved by the presence of an N-terminal extension, called a chloroplast transit peptide (CTP) or plastid transit peptide. Chromosomal transgenes from bacterial sources must have a sequence encoding a CTP sequence fused to a sequence encoding an expressed polypeptide if the expressed polypeptide is to be compartmentalized in the plant plastid (e.g., chloroplast).

Accordingly, localization of an exogenous polypeptide to a chloroplast is often 1 accomplished by means of operably linking a polynucleotide sequence encoding a CTP sequence to the 5' region of a polynucleotide encoding the exogenous polypeptide. The CTP is removed in a processing step during translocation into the plastid. Processing efficiency may, however, be affected by the amino acid sequence of the CTP and nearby sequences at the amino terminus of the peptide. Other options for targeting to the chloroplast which have been described are the maize cab-m7 signal sequence (U.S. Pat. No. 7,022,896, WO 97/41228) a pea glutathione reductase signal sequence (WO 97/41228) and the CTP described in US2009029861.

The RGE, RGN, or ndRGDBP polypeptide disclosed herein can further comprise at least one plastid targeting signal peptide, at least one mitochondrial targeting signal peptide, or a signal peptide targeting the RGE, RGN, or ndRGDBP polypeptide to both plastids and mitochondria. Plastid, mitochondrial, and dual-targeting signal peptide localization signals are known in the art (see, e.g., Nassoury and Morse (2005) Biochim Biophys Acta 1743:5-19; Kunze and Berger (2015) Front Physiol dx.doi.org/10.3389/fphys.2015.00259; Herrmann and Neupert (2003) IUBMB Life 55:219-225; Soll (2002) Curr Opin Plant Biol 5:529-535; Carrie and Small (2013) Biochim Biophys Acta 1833: 253-259; Carrie et al. (2009) FEBS J 276:1187-1195; Silva-Filho (2003) Curr Opin Plant Biol 6:589-595; Peeters and Small (2001) Biochim Biophys Acta 1541:54-63; Murcha et al. (2014) J Exp Bot 65:6301-6335; Mackenzie (2005) Trends Cell Biol 15:548-554; Glaser et al. (1998) Plant Mol Biol 38:311-338). The plastid, mitochondrial, or dual-targeting signal peptide can be located at the N-terminus, the C-terminus, or in an internal location of the RGE, RGN, or ndRGDBP polypeptide.

In some cases, an RGE, RGN, or ndRGDBP fusion polypeptide can comprise: a) an RGE, RGN, or ndRGDBP polypeptide; and b) an endosomal escape peptide (EEP). In some cases, an endosomal escape polypeptide comprises the amino acid sequence of SEQ ID NO: 110 or SEQ ID NO: 111.

For examples of some of the above fusion partners (and more) used in the context of fusions with Cas9, Zinc Finger, and/or TALE proteins (for site specific target nucleic modification, modulation of transcription, and/or target protein modification, e.g., histone modification), see, e.g.: Nomura et al J Am Chem Soc. 2007 Jul. 18; 129(28):8676-7; Rivenbark et al., Epigenetics. 2012 April; 7(4):350-60; Nucleic Acids Res. 2016 Jul. 8; 44(12):5615-28; Gilbert et al, Cell. 2013 Jul. 18; 154(2):442-51; Kearns et al, Nat Methods. 2015 May; 12(5):401-3; Mendenhall et al, Nat Biotechnol. 2013 December; 31(12): 1133-6; Hilton et al., Nat Biotechnol. 2015 May; 33(5):510-7; Gordley et al., Proc Natl Acad Sci USA. 2009 Mar. 31; 106(13):5053-8; Akopian et al., Proc Natl Acad Sci USA. 2003 Jul. 22; 100(15):8688-91; Tan et al., J Virol. 2006 February; 80(4): 1939-48; Tan et al., Proc Natl Acad Sci USA. 2003 Oct. 14; 100(21): 11997-2002; Papworth et al., Proc Natl Acad Sci USA. 2003 Feb. 18; 100(4): 1621-6; Sanjana et al., Nat Protoc. 2012 Jan. 5; 7(1): 171-92; Beerli et al., Proc Natl Acad Sci USA. 1998 Dec. 8; 95(25): 14628-33; Snowden et al., Curr Biol. 2002 Dec. 23; 12(24):2159-66; Xu et. al., Cell Discov. 2016 May 3; 2: 16009; Komor et al., Nature. 2016 Apr. 20; 533(7603):420-4; Chaikind et al., Nucleic Acids Res. 2016 Aug. 11; Choudhury at. al., Oncotarget. 2016 Jun. 23; Du et al., Cold Spring Harb Protoc. 2016 Jan. 4; Pham et al, Methods Mol Biol. 2016; 1358:43-57; Balboa et al., Stem Cell Reports. 2015 Sep. 8; 5(3):448-59; Hara et al., Sci Rep. 2015 Jun. 9; 5: 11221; Piatek et al., Plant Biotechnol J. 2015 May; 13(4):578-89; Hu et al., Nucleic Acids Res. 2014 April; 42(7):4375-90; Cheng et al., Cell Res. 2013 October; 23(10): 1163-71; Cheng et al, Cell Res. 2013 October; 23(10):1 163-71; and Maeder et al., Nat Methods. 2013 October; 10(10):977-9.

Additional suitable heterologous polypeptides that can be used in an RGE, RGN, or ndRGDBP fusion polypeptide include, but are not limited to, a polypeptide that directly and/or indirectly provides for increased transcription and/or translation of a target nucleic acid (e.g., a transcription activator or a fragment thereof, a protein or fragment thereof that recruits a transcription activator, a small molecule/drug-responsive transcription and/or translation regulator, a translation-regulating protein, etc.). Non-limiting examples of heterologous polypeptides to accomplish increased or decreased transcription include transcription activator and transcription repressor domains. In some such cases, a chimeric RGE, RGN, or ndRGDBP polypeptide or RGE, RGN, or ndRGDBP fusion polypeptide is targeted by the guide nucleic acid (guide RNA) to a specific location (i.e., sequence) in the target nucleic acid and exerts locus-specific regulation such as blocking RNA polymerase binding to a promoter (which selectively inhibits transcription activator function), and/or modifying the local chromatin status (e.g., when a fusion sequence is used that modifies the target nucleic acid or modifies a polypeptide associated with the target nucleic acid). In some cases, the changes are transient (e.g., transcription repression or activation). In some cases, the changes are inheritable (e.g., when epigenetic modifications are made to the target nucleic acid or to proteins associated with the target nucleic acid, e.g., nucleosomal histones).

Non-limiting examples of heterologous polypeptides for use when targeting ssRNA target nucleic acids include but are not limited to: splicing factors (e.g., RS domains); protein translation components (e.g., translation initiation, elongation, and/or release factors; e.g., eIF4G); RNA methylases; RNA editing enzymes (e.g., RNA deaminases, e.g., adenosine deaminase acting on RNA (ADAR), including A to I and/or C to U editing enzymes); helicases; RNA-binding proteins; and the like. It is understood that a heterologous polypeptide can include the entire protein or in some cases can include a fragment of the protein (e.g., a functional domain).

The heterologous polypeptide of a subject chimeric RGE, RGN, or ndRGDBP polypeptide or RGE, RGN, or ndRGDBP fusion polypeptide can be any domain capable of interacting with ssRNA (which, for the purposes of this disclosure, includes intramolecular and/or intermolecular secondary structures, e.g., double-stranded RNA duplexes such as hairpins, stem-loops, etc.), whether transiently or irreversibly, directly or indirectly, including but not limited to an effector domain selected from the group comprising: Endonucleases (for example RNase III, the CRR22 DYW domain, Dicer, and PIN (PilT N-terminus) domains from proteins such as SMG5 and SMG6); proteins and protein domains responsible for stimulating RNA cleavage (for example CPSF, CstF, CFIm and CFIIm); Exonucleases (for example XRN-1 or Exonuclease T); Deadenylases (for example HNT3); proteins and protein domains responsible for nonsense mediated RNA decay (for example UPF1, UPF2, UPF3, UPF3b, RNP SI, Y14, DEK, REF2, and SRm160); proteins and protein domains responsible for stabilizing RNA (for example PABP); proteins and protein domains responsible for repressing translation (for example Ago2 and Ago4); proteins and protein domains responsible for stimulating translation (for example Staufen); proteins and protein domains responsible for (e.g., capable of) modulating translation (e.g., translation factors such as initiation factors, elongation factors, release factors, etc., e.g., eIF4G); proteins and protein domains responsible for polyadenylation of RNA (for example PAP1, GLD-2, and Star-PAP); proteins and protein domains responsible for polyuridinylation of RNA (for example CI Dl and terminal uridylate transferase); proteins and protein domains responsible for RNA localization (for example from IMP1, ZBP1, She2p, She3p, and Bicaudal-D); proteins and protein domains responsible for nuclear retention of RNA (for example Rrp6); proteins and protein domains responsible for nuclear export of RNA (for example TAP, NXF1, THO, TREX, REF, and Aly); proteins and protein domains responsible for repression of RNA splicing (for example PTB, Sam68, and hnRNP A1); proteins and protein domains responsible for stimulation of RNA splicing (for example Serine/Arginine-rich (SR) domains); proteins and protein domains responsible for reducing the efficiency of transcription (for example FUS (TLS)); and proteins and protein domains responsible for stimulating transcription (for example CDK7 and HIV Tat). Alternatively, the effector domain may be selected from the group comprising Endonucleases; proteins and protein domains capable of stimulating RNA cleavage; Exonucleases; Deadenylases; proteins and protein domains having nonsense mediated RNA decay activity; proteins and protein domains capable of stabilizing RNA; proteins and protein domains capable of repressing translation; proteins and protein domains capable of stimulating translation; proteins and protein domains capable of modulating translation (e.g., translation factors such as initiation factors, elongation factors, release factors, etc., e.g., eIF4G); proteins and protein domains capable of polyadenylation of RNA; proteins and protein domains capable of polyuridinylation of RNA; proteins and protein domains having RNA localization activity; proteins and protein domains capable of nuclear retention of RNA; proteins and protein domains having RNA nuclear export activity; proteins and protein domains capable of repression of RNA splicing; proteins and protein domains capable of stimulation of RNA splicing; proteins and protein domains capable of reducing the efficiency of transcription; and proteins and protein domains capable of stimulating transcription. Another suitable heterologous polypeptide is a PUF RNA-binding domain, which is described in more detail in WO2012068627, which is hereby incorporated by reference in its entirety.

Some RNA splicing factors that can be used (in whole or as fragments thereof) as heterologous polypeptides for a chimeric RGE, RGN, or ndRGDBP polypeptide or RGE, RGN, or ndRGDBP fusion polypeptide have modular organization, with separate sequence-specific RNA binding modules and splicing effector domains. For example, members of the Serine/Arginine-rich (SR) protein family contain N-terminal RNA recognition motifs (RRMs) that bind to exonic splicing enhancers (ESEs) in pre-mRNAs and C-terminal RS domains that promote exon inclusion. As another example, the hnRNP protein hnRNP A1 binds to exonic splicing silencers (ESSs) through its RRM domains and inhibits exon inclusion through a C-terminal Glycine-rich domain. Some splicing factors can regulate alternative use of splice site (ss) by binding to regulatory sequences between the two alternative sites. For example, ASF/SF2 can recognize ESEs and promote the use of intron proximal sites, whereas hnRNP A1 can bind to ESSs and shift splicing towards the use of intron distal sites. One application for such factors is to generate ESFs that modulate alternative splicing of endogenous genes, particularly disease associated genes. For example, Bcl-x pre-mRNA produces two splicing isoforms with two alternative 5' splice sites to encode proteins of opposite functions. The long splicing isoform Bcl-xL is a potent apoptosis inhibitor expressed in long-lived postmitotic cells and is up-regulated in many cancer cells, protecting cells against apoptotic signals. The short isoform Bcl-xS is a pro-apoptotic isoform and expressed at high levels in cells with a high turnover rate (e.g., developing lymphocytes). The ratio of the two Bcl-x splicing isoforms is regulated by multiple cc-elements that are located in either the core exon region or the exon extension region (i.e., between the two alternative 5' splice sites). For more examples, see WO2010075303, which is hereby incorporated by reference in its entirety.

Further suitable fusion partners or RGE, RGN, or ndRGDBP fusion polypeptide RGE, RGN, or ndRGDBP fusion polypeptide include, but are not limited to proteins (or fragments thereof) that are boundary elements (e.g., CTCF), proteins and fragments thereof that provide periphery recruitment (e.g., Lamin A, Lamin B, etc.), protein docking elements (e.g., FKBP/FRB, Pill/Abyl, etc.).

Examples of various additional suitable heterologous polypeptide (or fragments thereof) that can be adapted for use in a subject synthetic polynucleotide encoding a chimeric RGE, RGN, or ndRGDBP polypeptide or RGE, RGN, or ndRGDBP fusion polypeptide include, but are not limited to those described in the following applications (which publications are related to other CRISPR endonucleases such as Cas9, but the described fusion partners can also be used with RGE, RGN, or ndRGDBP instead): PCT patent applications: WO2010075303, WO2012068627, and WO2013155555, and can be found, for example, in U.S. patents and patent applications: U.S. Pat. Nos. 8,906,616; 8,895,308; 8,889, 418; 8,889,356; 8,871,445; 8,865,406; 8,795,965; 8,771, 945; 8,697,359; 20140068797; 20140170753; 20140179006; 20140179770; 20140186843; 20140186919; 20140186958; 20140189896; 20140227787; 20140234972; 20140242664; 20140242699; 20140242700; 20140242702; 20140248702; 20140256046; 20140273037; 20140273226; 20140273230; 20140273231; 20140273232; 20140273233; 20140273234; 20140273235; 20140287938; 20140295556; 20140295557; 20140298547; 20140304853; 20140309487; 20140310828; 20140310830; 20140315985; 20140335063; 20140335620; 20140342456; 20140342457; 20140342458; 20140349400; 20140349405; 20140356867; 20140356956; 20140356958; 20140356959; 20140357523; 20140357530; 20140364333; and 20140377868; all of which are hereby incorporated by reference in their entirety.

In some cases, a heterologous polypeptide (a fusion partner) or RGE, RGN, or ndRGDBP fusion polypeptide provides for subcellular localization, e.g., the heterologous polypeptide contains a subcellular localization sequence (e.g., a nuclear localization signal (NLS) for targeting to the nucleus, a sequence to keep the fusion protein out of the nucleus, e.g., a nuclear export sequence (NES), a sequence to keep the fusion protein retained in the cytoplasm, a mitochondrial localization signal for targeting to the mitochondria, a chloroplast localization signal for targeting to a chloroplast, an ER retention signal, and the like). In some embodiments, an RGE, RGN, or ndRGDBP fusion polypeptide does not include a NLS so that the protein is not targeted to the nucleus (which can be advantageous, e.g., when the target nucleic acid is an RNA that is present in the cytosol). In some embodiments, the heterologous polypeptide can provide a tag or an epitope tag (e.g., the heterologous polypeptide is a detectable label) for ease of tracking and/or purification (e.g., a fluorescent protein, e.g., green fluorescent protein (GFP), YFP, RFP, CFP, mCherry, tdTomato, mScarlett, and the like; a histidine tag, e.g., a 6×His tag; a hemagglutinin (HA) tag; a FLAG tag; a Myc tag; and the like).

In some cases, an RGE, RGN, or ndRGDBP is operably linked to a nuclear localization signal (NLS) (e.g., in some cases 2 or more, 3 or more, 4 or more, or 5 or more NLSs). Thus, in some cases, an RGE, RGN, or ndRGDBP fusion polypeptide includes one or more NLSs (e.g., 2 or more, 3 or more, 4 or more, or 5 or more NLSs). In some cases, one or more NLSs (2 or more, 3 or more, 4 or more, or 5 or more NLSs) are positioned at or near (e.g., within 50 amino acids of) the N-terminus and/or the C-terminus. In some cases, one or more NLSs (2 or more, 3 or more, 4 or more, or 5 or more NLSs) are positioned at or near (e.g., within 50 amino acids of) the N-terminus. In some cases, one or more NLSs (2 or more, 3 or more, 4 or more, or 5 or more NLSs) are positioned at or near (e.g., within 50 amino acids of) the C-terminus. In some cases, one or more NLSs (3 or more, 4 or more, or 5 or more NLSs) are positioned at or near (e.g., within 50 amino acids of) both the N-terminus and the C-terminus. In some cases, an NLS is positioned at the N-terminus and an NLS is positioned at the C-terminus.

Non-limiting examples of NLSs include NLS that comprise at least 4 consecutive basic amino acids such as the SV40 large T antigen NLS (PKKKRKV; SEQ ID NO: 112), maize opaque-2 nuclear localization signal (SEQ ID NO: 113), and an extended SV40 large T antigen NLS (SEQ ID NO: 114). In general, NLS (or multiple NLSs) are of sufficient strength to drive accumulation of the RGE, RGN, or ndRGDBP protein in a detectable amount in the nucleus of a eukaryotic cell. Detection of accumulation in the nucleus may be performed by any suitable technique. For example, a detectable marker may be fused to the RGE, RGN, or ndRGDBP protein such that location within a cell may be visualized. Cell nuclei may also be isolated from cells, the contents of which may then be analyzed by any suitable process for detecting protein, such as immunohistochemistry, Western blot, or enzyme activity assay. Accumulation in the nucleus may also be determined indirectly.

In some cases, an RGE, RGN, or ndRGDBP fusion polypeptide includes a "Protein Transduction Domain" or PTD (also known as a CPP—cell penetrating peptide), which refers to a polypeptide, polynucleotide, carbohydrate, or organic or inorganic compound that facilitates traversing a lipid bilayer, micelle, cell membrane, organelle membrane, or vesicle membrane. A PTD attached to another molecule, which can range from a small polar molecule to a large macromolecule and/or a nanoparticle, facilitates the molecule traversing a membrane, for example going from extracellular space to intracellular space, or cytosol to within an organelle. In some embodiments, a PTD is covalently linked to the amino terminus a polypeptide (e.g., linked to an RGE, RGN, or ndRGDBP) to generate a fusion protein. In some embodiments, a PTD is covalently linked to the carboxyl terminus of a polypeptide (e.g., linked to a wild type RGE, RGN, or ndRGDBP to generate a fusion protein, or linked to a variant RGE, RGN, or ndRGDBP protein such as an RGE, RGN, or ndRGDBP, nickase RGE, RGN, or ndRGDBP, or chimeric RGE, RGN, or ndRGDBP protein or RGE, RGN, or ndRGDBP fusion polypeptide to generate a fusion protein). In some cases, the PTD is inserted internally in the RGE, RGN, or ndRGDBP fusion polypeptide (i.e., is not at the N- or C-terminus of the RGE, RGN, or ndRGDBP fusion polypeptide) at a suitable insertion site. In some cases, a subject RGE, RGN, or ndRGDBP fusion polypeptide includes (is conjugated to, is fused to) one or more PTDs (e.g., two or more, three or more, four or more PTDs). In some cases, a PTD includes a nuclear localization signal (NLS) (e.g., in some cases 2 or more, 3 or more, 4 or more, or 5 or more NLSs). Thus, in some cases, an RGE, RGN, or ndRGDBP fusion polypeptide includes one or more NLSs (e.g., 2 or more, 3 or more, 4 or more, or 5 or more NLSs). In some embodiments, a PTD is covalently linked to a nucleic acid (e.g., an RGE, RGN, or ndRGDBP guide nucleic acid, a polynucleotide encoding an RGE, RGN, or ndRGDBP guide nucleic acid, a polynucleotide encoding an RGE, RGN, or ndRGDBP fusion polypeptide, a donor template DNA molecule, etc.). Examples of PTDs include but are not limited to a minimal undecapeptide protein transduction domain (corresponding to residues 47-57 of HIV-1 TAT comprising YGRKKRRQRRR (SEQ ID NO: 115); a polyarginine sequence comprising a number of arginines sufficient to direct entry into a cell (e.g., 3, 4, 5, 6, 7, 8, 9, 10, or 10-50 arginines); a VP22 domain (Zender et al. (2002) Cancer Gene Ther. 9(6):489-96); a *Drosophila* Antennapedia protein transduction domain (Noguchi et al. (2003) Diabetes 52(7): 1732-1737); a truncated human calcitonin peptide (Trehin et al. (2004) Pharm. Research 21: 1248-1256); polylysine (Wender et al. (2000) Proc. Natl. Acad. Sci. USA 97: 13003-13008); Transportan; Exemplary PTDs include but are not limited to, an arginine homopolymer of from 3 arginine residues to 50 arginine residues. In some embodiments, the PTD is an activatable CPP (ACPP) (Aguilera et al. (2009) Integr Biol (Camb) June; 1(5-6): 371-381). ACPPs comprise a polycationic CPP (e.g., Arg9 or "R9") connected via a cleavable linker to a matching polyanion (e.g., Glu9 or "E9"), which reduces the net charge to nearly zero and thereby inhibits adhesion and uptake into cells. Upon cleavage of the linker, the polyanion is released, locally unmasking the polyarginine and its inherent adhesiveness, thus "activating" the ACPP to traverse the membrane.

In some embodiments, a subject RGE, RGN, or ndRGDBP protein can fused to a fusion partner via a linker polypeptide (e.g., one or more linker polypeptides). The linker polypeptide may have any of a variety of amino acid sequences. Proteins can be joined by a spacer peptide, generally of a flexible nature, although other chemical linkages are not excluded. Suitable linkers include polypeptides of between 4 amino acids and 40 amino acids in length, or between 4 amino acids and 25 amino acids in length. These linkers can be produced by using synthetic, linker-encoding oligonucleotides to couple the proteins, or can be encoded by a nucleic acid sequence encoding the fusion protein. Peptide linkers with a degree of flexibility can be used. The linking peptides may have virtually any amino acid sequence, bearing in mind that the preferred linkers will have a sequence that results in a generally flexible peptide. The use of small amino acids, such as glycine and alanine, are of use in creating a flexible peptide. The creation of such sequences is routine to those of skill in the art. A variety of different linkers are commercially available and are considered suitable for use.

Examples of linker polypeptides include glycine polymers $(G)_n$, glycine-serine polymers (including, for example, $(GS)_n$, $GSGGS_n$ (SEQ ID NO: 116), $GGSGGS_n$ (SEQ ID NO: 117), and $GGGS_n$ (SEQ ID NO: 118), where n is an integer of at least one), glycine-alanine polymers, alanine-serine polymers. The ordinarily skilled artisan will recognize that design of a peptide conjugated to any desired element can include linkers that are all or partially flexible, such that the linker can include a flexible linker as well as one or more portions that confer less flexible structure.

An RGE, RGN, or ndRGDBP guide RNA can be said to include two segments, a targeting segment and a protein-binding segment. The targeting segment of an RGE, RGN, or ndRGDBP guide RNA includes a nucleotide sequence (a guide sequence) that is complementary to (and therefore hybridizes with) a specific sequence (a target site) within a target nucleic acid (e.g., a target ssRNA, a target ssDNA, the complementary strand of a double stranded target DNA, etc.). Site-specific binding and/or cleavage of a target nucleic acid (e.g., genomic DNA) can occur at locations (e.g., target sequence of a target locus) determined by base-pairing complementarity between the RGE, RGN, or ndRGDBP guide RNA (the guide sequence of the RGE, RGN, or ndRGDBP guide RNA) and the target nucleic acid. Design of guide RNAs for Cas9 and Cas12 RGE, RGN, and ndDBP is set forth in Robb, G. B. Genome editing with CRISPR-Cas: an overview. Current Protocols Essential Laboratory Techniques, 19, e36. doi: 10.1002/cpet.36; (2019).

The protein-binding segment (or "protein-binding sequence") interacts with (binds to) an RGE, RGN, or ndRGDBP polypeptide.

In some cases, the protein-binding segment is made up of a short sequence of 17-20 or 16-36 nucleotides, such as a sequence of 18 or 19 or about 24 to 29 nucleotides. This protein binding segment forms a double-stranded RNA duplex of five paired residues in length. The 5' terminus has about three or 9-14 residues upstream from the first RNA duplexed residue. A stem structure of 4-5 residues separates the double stranded regions. See Pausch et al., Science 369, 333-337 (2020).

In some cases, the protein-binding segment of a subject RGE, RGN, or ndRGDBP guide RNA includes two complementary stretches of nucleotides that hybridize to one another to form a double stranded RNA duplex (dsRNA duplex). In some embodiments where the subject synthetic polynucleotide encodes a protein having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the RGE, RGN, or ndRGDBP CasJ protein sequence set forth as SEQ ID NO: 37, the protein binding segment can be made up, for example, an RNA encoded by the DNA molecule of SEQ ID NO: 119. In some embodiments where the subject synthetic polynucleotide encodes a protein having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the RGE or ndRGDBP Cas12j-1 protein sequence set forth as SEQ ID NO: 120, the protein binding segment can be made up, for example, an RNA encoded by the DNA molecule of SEQ ID NO: 186 or a 3' fragment thereof.

In some embodiments where the subject synthetic polynucleotide encodes a protein having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the RGE or ndRGDBP Cas12j-2 protein sequence set forth as SEQ ID NO: 132, the protein binding segment can be made up, for example, an RNA encoded by the DNA molecule of SEQ ID NO: 187 or a 3' fragment thereof.

In some embodiments where the subject synthetic polynucleotide encodes a protein having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the RGE or ndRGDBP Cas12j-3 protein sequence set forth as SEQ ID NO: 144, the protein binding segment can be made up, for example, an RNA encoded by the DNA molecule of SEQ ID NO: 188 or a 3' fragment thereof.

An RGE, RGN, or ndRGDBP guide RNA and an RGE, RGN, or ndRGDBP protein, e.g., a fusion RGE, RGN, or ndRGDBP polypeptide, form a complex (e.g., bind via non-covalent interactions). The RGE, RGN, or ndRGDBP guide RNA provides target specificity to the complex by including a targeting segment, which includes a guide sequence (a nucleotide sequence that is complementary to a sequence of a target nucleic acid). The RGE, RGN, or ndRGDBP protein of the complex provides the site-specific activity (e.g., cleavage activity provided by the RGE, RGN, or ndRGDBP protein or RGE, RGN, or ndRGDBP fusion polypeptide and/or an activity provided by the fusion partner in the case of a chimeric RGE, RGN, or ndRGDBP protein or RGE, RGN, or ndRGDBP fusion polypeptide). In other words, the RGE, RGN, or ndRGDBP protein is guided to a target nucleic acid sequence (e.g., a target sequence) by virtue of its association with the RGE, RGN, or ndRGDBP guide RNA.

The "guide sequence" also referred to as the "targeting sequence" of an RGE, RGN, or ndRGDBP guide RNA can be made so that the RGE, RGN, or ndRGDBP guide RNA can target an RGE, RGN, or ndRGDBP protein (e.g., a naturally-occurring RGE, RGN, or ndRGDBP protein, a fusion RGE, RGN, or ndRGDBP polypeptide (e.g., chimeric RGE, RGN, or ndRGDBP), and the like) to any desired sequence of any desired target nucleic acid, with the exception (e.g., as described herein) that the protospacer adjacent motif (PAM) sequence can be taken into account. In general, the targeting sequence of the guide RNA typically comprises about an 18 or 19 to about a 21 or 22 nucleotide sequence which corresponds to the sequence immediately adjacent to the 5' end of a PAM (e.g., for Cas9 and similar RNA directed nucleases) or about a 20, 21, 22, 23, or 24 nucleotide sequence which corresponds to the sequence immediately adjacent to the 3' end of a PAM (e.g., for Cas12a (i.e., Cpf1) and similar RNA directed nucleases). Thus, for example, an RGE, RGN, or ndRGDBP guide RNA can have a guide sequence with complementarity to (e.g., can hybridize to) a sequence in a nucleic acid in a eukaryotic cell, e.g., a viral nucleic acid, a eukaryotic nucleic acid (e.g., a eukaryotic chromosome, chromosomal sequence, a eukaryotic RNA, etc.), and the like.

In some embodiments where the subject synthetic polynucleotide encodes a protein having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the RGE, RGN, or ndRGDBP CasJ protein sequence set forth as SEQ ID NO: 37, the PAM for a CasJ RGE, RGN, or ndRGDBP is immediately 5' of the target sequence of the non-complementary strand of the target DNA (the complementary strand hybridizes to the guide sequence of the guide RNA while the non-complementary strand does not directly hybridize with the guide RNA and is the reverse complement of the complementary strand). In some embodiments (e.g., when an aforementioned CasJ protein is used), the PAM consensus sequence of the non-complementary strand is T-rich. Examples of PAM sequences include, but are not limited to, TTN, CTN, TCN, CCN, TTTN, TCTN, TTCN, CTTN, ATTN, TCCN, TTGN, GTTN, CCCN, CCTN, TTAN, TCGN, CTCN, ACTN, GCTN, TCAN, GCCN, and CCGN (wherein N is defined as any nucleotide).

In some embodiments where the subject synthetic polynucleotide encodes a protein having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the RGE or ndRGDBP Cas12j protein sequence set forth as SEQ ID NO: 120, 132, or 144, the PAM for a Cas12j RGE or ndRGDBP is immediately 5' of the target sequence of the non-complementary strand of the target DNA (the complementary strand hybridizes to the guide sequence of the guide RNA while the non-complementary strand does not directly hybridize with the guide RNA and is the reverse complement of the complementary strand). In some embodiments, e.g., when a Cas12j-1 protein (SEQ ID NO: 120) is used, the PAM consensus sequence of the non-complementary strand is 5'-VTTR-3' (where V is A, C, or G, and R is A or G). In some embodiments, e.g., when a Cas12j-2 protein (SEQ ID NO: 132) is used, the PAM consensus sequence of the non-complementary strand is 5'-TBN-3' (where B is G, T, or C, and N is A, T, C, or G). In some embodiments, e.g., when a Cas12j-3 protein (SEQ ID NO: 144) is used, the PAM consensus sequence of the non-complementary strand is VTTN.

In some embodiments a subject RGE, RGN, or ndRGDBP guide RNA can also be said to include an "activator" and a "targeter" (e.g., an "activator-RNA" and a "targeter-RNA," respectively). When the "activator" and a "targeter" are two separate molecules the guide RNA is referred to herein as a "dual guide RNA", a "dgRNA," a "double-molecule guide RNA", or a "two-molecule guide RNA." (e.g., a "RGE, RGN, or ndRGDBP dual guide RNA"). In some embodiments, the activator and targeter are covalently linked to one another (e.g., via intervening nucleotides) and the guide RNA is referred to herein as a "single guide RNA", an "sgRNA," a "single-molecule guide RNA," or a "one-molecule guide RNA" (e.g., a "RGE, RGN, or ndRGDBP single guide RNA"). Thus, a subject RGE, RGN, or ndRGDBP single guide RNA comprises a targeter (e.g., targeter-RNA) and an activator (e.g., activator-RNA) that are linked to one another (e.g., by intervening nucleotides), and may hybridize to one another to form the double stranded RNA duplex (dsRNA duplex) of the protein-binding segment of the guide RNA, thus resulting in a stem-loop structure. Thus, the targeter and the activator each have a duplex-forming segment, where the duplex forming segment of the targeter and the duplex-forming segment of the activator have complementarity with one another and hybridize to one another.

In some embodiments, the linker of an RGE, RGN, or ndRGDBP single guide RNA is a stretch of nucleotides. In some cases, the targeter and activator of an RGE, RGN, or ndRGDBP single guide RNA are linked to one another by intervening nucleotides and the linker can have a length of from 3 to 20 nucleotides (nt) (e.g., from 3 to 15, 3 to 12, 3 to 10, 3 to 8, 3 to 6, 3 to 5, 3 to 4, 4 to 20, 4 to 15, 4 to 12, 4 to 10, 4 to 8, 4 to 6, or 4 to 5 nt). In some embodiments, the linker of an RGE, RGN, or ndRGDBP single guide RNA can have a length of from 3 to 100 nucleotides (nt) (e.g., from 3 to 80, 3 to 50, 3 to 30, 3 to 25, 3 to 20, 3 to 15, 3 to 12, 3 to 10, 3 to 8, 3 to 6, 3 to 5, 3 to 4, 4 to 100, 4 to 80, 4 to 50, 4 to 30, 4 to 25, 4 to 20, 4 to 15, 4 to 12, 4 to 10, 4 to 8, 4 to 6, or 4 to 5 nt). In some embodiments, the linker of an RGE, RGN, or ndRGDBP single guide RNA can have a length of from 3 to 10 nucleotides (nt) (e.g., from 3 to 9, 3 to 8, 3 to 7, 3 to 6, 3 to 5, 3 to 4, 4 to 10, 4 to 9, 4 to 8, 4 to 7, 4 to 6, or 4 to 5 nt).

The targeting segment of a subject RGE, RGN, or ndRGDBP guide RNA includes a guide sequence (i.e., a targeting sequence), which is a nucleotide sequence that is complementary to a sequence (a target site) in a target nucleic acid. In other words, the targeting segment of an RGE, RGN, or ndRGDBP guide RNA can interact with a target nucleic acid (e.g., double stranded DNA (dsDNA), single stranded DNA (ssDNA), single stranded RNA (ssRNA), or double stranded RNA (dsRNA)) in a sequence-specific manner via hybridization (i.e., base pairing). The guide sequence of an RGE, RGN, or ndRGDBP guide RNA can be modified (e.g., by genetic engineering)/designed to hybridize to any desired target sequence (e.g., while taking the PAM into account, e.g., when targeting a dsDNA target) within a target nucleic acid (e.g., a eukaryotic target nucleic acid such as genomic DNA).

In some embodiments, the percent complementarity between the guide sequence and the target site of the target nucleic acid is 60% or more (e.g., 65% or more, 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid is 80% or more (e.g., 85% or more, 90% or more, 95% or more, 97% or more, 98% or more, 99% or more, or 100%). In some cases, the percent complementarity between the guide sequence and the target site of the target nucleic acid is 90% or more (e.g., 95% or more, 97% or more, 98% or more, 99% or more, or 100%). In some cases, the percent complementarity between the guide sequence and the target site of the target nucleic acid is 100%.

In some cases, the percent complementarity between the guide sequence and the target site of the target nucleic acid is 100% over the seven contiguous 3'-most nucleotides of the target site of the target nucleic acid.

The present disclosure provides one or more nucleic acids comprising one or more of: a donor template DNA molecule sequence (for homology directed repair of a target gene), a subject synthetic polynucleotide sequence encoding an RGE, RGN, or ndRGDBP polypeptide or fusion polypeptide, and the like, an RGE, RGN, or ndRGDBP guide RNA, and a nucleotide sequence encoding an RGE, RGN, or ndRGDBP guide RNA (which can include two separate nucleotide sequences in the case of dual guide RNA format or which can include a single nucleotide sequence in the case of single guide RNA format). The present disclosure provides a nucleic acid comprising a nucleotide sequence encoding an RGE, RGN, or ndRGDBP fusion polypeptide encoded by a subject synthetic polynucleotide. The present disclosure provides a recombinant expression vector that comprises a subject synthetic polynucleotide sequence encoding an RGE, RGN, or ndRGDBP polypeptide. The present disclosure provides a recombinant expression vector that comprises a subject synthetic polynucleotide encoding an RGE, RGN, or ndRGDBP fusion polypeptide. The present disclosure provides a recombinant expression vector that comprises a subject synthetic polynucleotide encoding an RGE, RGN, or ndRGDBP polypeptide. The present disclosure provides a recombinant expression vector that comprises: a) a subject synthetic polynucleotide encoding an RGE, RGN, or ndRGDBP fusion polypeptide; and b) a nucleotide sequence encoding an RGE, RGN, or ndRGDBP guide RNA(s). In some cases, the subject synthetic polynucleotide encoding the RGE, RGN, or ndRGDBP protein and/or the nucleotide sequence encoding the RGE, RGN, or ndRGDBP guide RNA is operably linked to a promoter that is operable in a cell type of choice (e.g., a prokarytoic cell, a eukaryotic cell, a plant cell including a soybean plant cell, an animal cell, a mammalian cell, a primate cell, a rodent cell, a human cell, etc.).

The present disclosure provides one or more recombinant expression vectors that include (in different recombinant expression vectors in some cases, and in the same recombinant expression vector in some cases): (i) a nucleotide sequence of a donor template DNA molecule (where the donor template DNA molecule comprises a nucleotide sequence having homology to a target sequence of a target nucleic acid (e.g., a target genome)); (ii) a nucleotide sequence that encodes an RGE, RGN, or ndRGDBP guide RNA that hybridizes to a target sequence of the target locus of the targeted genome (e.g., a single or dual guide RNA) (e.g., operably linked to a promoter that is operable in a target cell such as a eukaryotic cell); and (iii) a subject synthetic polynucleotide encoding an RGE, RGN, or ndRGDBP protein (e.g., operably linked to a promoter that is operable in a target cell such as a eukaryotic cell or soybean cell). The present disclosure provides one or more recombinant expression vectors that include (in different recombinant expression vectors in some cases, and in the same recombinant expression vector in some cases): (i) a nucleotide sequence of a donor template DNA molecule (where the donor template DNA molecule comprises a nucleotide sequence having homology to a target sequence of a target nucleic acid (e.g., a target genome)); and (ii) a nucleic acid that encodes an RGE, RGN, or ndRGDBP guide RNA that hybridizes to a target sequence of the target locus of the targeted genome (e.g., a single or dual guide RNA) (e.g., operably linked to a promoter that is operable in a target cell such as a eukaryotic cell). The present disclosure provides one or more recombinant expression vectors that include (in different recombinant expression vectors in some cases, and in the same recombinant expression vector in some cases): (i) a subject synthetic polynucleotide that encodes an RGE, RGN, or ndRGDBP guide RNA that hybridizes to a target sequence of the target locus of the targeted genome (e.g., a single or dual guide RNA) (e.g., operably linked to a promoter that is operable in a target cell such as a soybean plant cell); and (ii) a subject synthetic polynucleotide encoding an RGE, RGN, or ndRGDBP protein (e.g., operably linked to a promoter that is operable in a target cell such as a eukaryotic cell).

Depending on the host/vector system utilized, any of a number of suitable transcription and translation control elements, including constitutive and inducible promoters, transcription enhancer elements, transcription terminators, etc. may be used in the expression vector.

In some embodiments, a subject synthetic polynucleotide encoding an RGE, RGN, or ndRGDBP guide RNA is operably linked to a control element, e.g., a transcriptional control element, such as a promoter. In some embodiments, a subject synthetic polynucleotide encoding an RGE, RGN, or ndRGDBP protein or an RGE, RGN, or ndRGDBP fusion polypeptide is operably linked to a control element, e.g., a transcriptional control element, such as a promoter.

The transcriptional control element can be a promoter. In some cases, the promoter is a constitutively active promoter. In some cases, the promoter is a regulatable promoter. In some cases, the promoter is an inducible promoter. In some cases, the promoter is a tissue-specific promoter. In some cases, the promoter is a cell type-specific promoter. In some cases, the transcriptional control element (e.g., the promoter) is functional in a targeted cell type or targeted cell population.

In some embodiments, a subject synthetic polynucleotide encoding an RGE, RGN, or ndRGDBP guide RNA and/or an RGE, RGN, or ndRGDBP fusion polypeptide is operably linked to an inducible promoter. In some embodiments, a subject synthetic polynucleotide encoding an RGE, RGN, or ndRGDBP guide RNA and/or an RGE, RGN, or ndRGDBP fusion protein is operably linked to a constitutive promoter.

Methods of introducing a nucleic acid (e.g., a nucleic acid comprising a donor template DNA molecule sequence, one or more subject synthetic polynucleotides encoding an RGE, RGN, or ndRGDBP protein and/or an RGE, RGN, or ndRGDBP guide RNA, and the like) into a host cell are known in the art, and any convenient method can be used to introduce a nucleic acid (e.g., an expression construct) into a cell. Suitable methods include e.g., viral infection, transfection, lipofection, electroporation, calcium phosphate precipitation, polyethyleneimine (PEI)-mediated transfection, DEAE-dextran mediated transfection, liposome-mediated transfection, particle gun technology, calcium phosphate precipitation, direct microinjection, nanoparticle-mediated nucleic acid delivery, and the like.

Introducing the recombinant expression vector into cells can occur in any culture media and under any culture conditions that promote the survival of the cells. Introducing the recombinant expression vector into a target cell can be carried out in vivo or ex vivo. Introducing the recombinant expression vector into a target cell can be carried out in vitro.

In some embodiments, a subject synthetic polynucleotide encoding an RGE, RGN, or ndRGDBP protein can be provided as RNA. The RNA can be provided by direct chemical synthesis or may be transcribed in vitro from a DNA (e.g., encoding the RGE, RGN, or ndRGDBP protein). Once synthesized, the RNA may be introduced into a cell by any of the well-known techniques for introducing nucleic acids into cells (e.g., microinjection, electroporation, transfection, etc.).

Nucleic acids may be provided to the cells using well-developed transfection techniques; see, e.g., Angel and Yanik (2010) PLoS ONE 5(7): e1 1756, and the commercially available TransMessenger® reagents from Qiagen, Stemfect™ RNA Transfection Kit from Stemgent, and TransIT®-mRNA Transfection Kit from Mirus Bio LLC.

Vectors may be provided directly to a target host cell. In other words, the cells are contacted with vectors comprising the subject synthetic polynucleotides (e.g., recombinant expression vectors encoding the RGE, RGN, or ndRGDBP protein; etc.) such that the vectors are taken up by the cells. Methods for contacting cells with nucleic acid vectors that are plasmids, include electroporation, calcium chloride transfection, microinjection, and lipofection are well known in the art. For viral vector delivery, cells can be contacted with viral particles comprising the subject viral expression vectors (e.g., gemini virus vectors, TMV vectors, and the like) containing the subject synthetic polynucleotides.

Vectors used for providing the nucleic acids encoding RGE, RGN, or ndRGDBP guide RNA and/or an RGE, RGN, or ndRGDBP polypeptide or fusion polypeptide to a target host cell can include suitable promoters for driving the expression, that is, transcriptional activation, of the nucleic acid of interest. In other words, in some cases, the nucleic acid of interest will be operably linked to a promoter. This may include ubiquitously acting promoters, for example, a viral promoter (e.g., CaMV35S or CaMV19S), actin promoter, or inducible promoters, such as promoters that are active in particular cell populations or that respond to the presence of drugs such as tetracycline. By transcriptional activation, it is intended that transcription will be increased above basal levels in the target cell by 10 fold, by 100 fold, more usually by 1000 fold. In addition, vectors used for providing a nucleic acid encoding an RGE, RGN, or ndRGDBP guide RNA and/or an RGE, RGN, or ndRGDBP protein to a cell may include nucleic acid sequences that encode for selectable markers in the target cells, so as to identify cells that have taken up the RGE, RGN, or ndRGDBP guide RNA and/or RGE, RGN, or ndRGDBP protein.

A nucleic acid comprising a subject synthetic polynucleotide encoding an RGE, RGN, or ndRGDBP polypeptide, or an RGE, RGN, or ndRGDBP fusion polypeptide, is in some cases an RNA. Thus, an RGE, RGN, or ndRGDBP fusion protein can be introduced into cells as RNA. Methods of introducing RNA into cells are known in the art and may include, for example, direct injection, transfection, or any other method used for the introduction of DNA.

Any of a variety of compounds, vector systems (e.g., bacterial plant transformation vector systems), and methods can be used to deliver to a target cell (e.g., a plant cell including a soybean cell) an RGE, RGN, or ndRGDBP system comprising a subject synthetic polynucleotide. An RGE, RGN, or ndRGDBP system provided herein includes systems which can comprise: (a) a subject synthetic polynucleotide encoding an RGE, RGN, or ndRGDBP polypeptide, an RGE, RGN, or ndRGDBP guide RNA, and a donor template DNA molecule; (b) a subject synthetic polynucleotide comprising an mRNA encoding an RGE, RGN, or ndRGDBP polypeptide; and an RGE, RGN, or ndRGDBP guide RNA; (c) a subject synthetic polynucleotide comprising an mRNA encoding an RGE, RGN, or ndRGDBP polypeptide, an RGE, RGN, or ndRGDBP guide RNA, and a donor template DNA molecule; (d) a subject synthetic polynucleotide comprising an mRNA encoding an RGE, RGN, or ndRGDBP fusion polypeptide; and an RGE, RGN, or ndRGDBP guide RNA; (e) a subject synthetic polynucleotide comprising an mRNA encoding an RGE, RGN, or ndRGDBP fusion polypeptide, an RGE, RGN, or ndRGDBP guide RNA, and a donor template DNA molecule; (f) a recombinant expression vector comprising a subject synthetic polynucleotide encoding an RGE, RGN, or ndRGDBP polypeptide and a nucleotide sequence encoding an RGE, RGN, or ndRGDBP guide RNA; (g) a recombinant expression vector comprising a subject synthetic polynucleotide encoding an RGE, RGN, or ndRGDBP polypeptide, a nucleotide sequence encoding an RGE, RGN, or ndRGDBP guide RNA, and a nucleotide sequence encoding a donor template DNA molecule; (h) a recombinant expression vector comprising a subject synthetic polynucleotide encoding an RGE, RGN, or ndRGDBP fusion polypeptide and a nucleotide sequence encoding an RGE, RGN, or ndRGDBP guide RNA; (i) a recombinant expression vector comprising a subject synthetic polynucleotide encoding an RGE, RGN, or ndRGDBP fusion polypeptide, a nucleotide sequence encoding an RGE, RGN, or ndRGDBP guide RNA, and a nucleotide sequence encoding a donor template DNA molecule; (j) a first recombinant expression vector comprising a subject synthetic polynucleotide encoding an RGE, RGN, or ndRGDBP polypeptide, and a second recombinant expression vector comprising a nucleotide sequence encoding an RGE, RGN, or ndRGDBP guide RNA; (k) a first recombinant expression vector comprising a subject synthetic polynucleotide encoding an RGE, RGN, or ndRGDBP polypeptide, and a second recombinant expression vector comprising a nucleotide sequence encoding an RGE, RGN, or ndRGDBP guide RNA; and a donor template DNA molecule; (l) a first recombinant expression vector comprising a subject synthetic polynucleotide encoding an RGE, RGN, or ndRGDBP fusion polypeptide, and a second recombinant expression vector comprising a nucleotide sequence encoding an RGE, RGN, or ndRGDBP guide RNA; (m) a first recombinant expression vector comprising a subject synthetic polynucleotide encoding an RGE, RGN, or ndRGDBP fusion polypeptide, and a second recombinant expression vector comprising a nucleotide sequence encoding an RGE, RGN, or ndRGDBP guide RNA; and a donor template DNA molecule; (n) a recombinant expression vector comprising a subject synthetic polynucleotide encoding an RGE, RGN, or ndRGDBP polypeptide, a nucleotide sequence encoding a first RGE, RGN, or ndRGDBP guide RNA, and a nucleotide sequence encoding a second RGE, RGN, or ndRGDBP guide RNA; or (o) a recombinant expression vector comprising a subject synthetic polynucleotide encoding an RGE, RGN, or ndRGDBP fusion polypeptide, a nucleotide sequence encoding a first RGE, RGN, or ndRGDBP guide RNA, and a nucleotide sequence encoding a second RGE, RGN, or ndRGDBP guide RNA; or some variation of one of (a) through (o). As a non-limiting example, an RGE, RGN, or ndRGDBP system can be combined with a lipid. As another non-limiting example, an RGE, RGN, or ndRGDBP system can be combined with a particle, or formulated into a particle. As another non-limiting example, an RGE, RGN, or ndRGDBP system can be contained in or delivered to a plant cell (e.g., a soybean plant cell).

Methods of introducing a nucleic acid into a host cell are known in the art, and any convenient method can be used to introduce a subject synthetic polynucleotide (e.g., an expression construct/vector) or RGE, RGN, or ndRGDBP system comprising the same into a target cell (e.g., prokaryotic cell, eukaryotic cell, plant cell such as a soybean plant cell, animal cell, mammalian cell, human cell, and the like). Suitable methods include, e.g., viral infection, transfection, conjugation, protoplast fusion, lipofection, electroporation, calcium phosphate precipitation, polyethyleneimine (PEI)-mediated transfection, DEAE-dextran mediated transfection, liposome-mediated transfection, particle gun technology, calcium phosphate precipitation, direct micro injection, nanoparticle-mediated nucleic acid delivery (see, e.g., Panyam et., al Adv Drug Deliv Rev. 2012 Sep. 13. pii: S0169-409X(12)00283-9. doi: 10.1016/j.addr.2012.09.023), and the like. In plants, bacterially mediated (e.g., *Agrobacterium* sp., *Rhizobium* sp., *Sinorhizobium* sp., *Mesorhizobium* sp., *Bradyrhizobium* sp., Azobacter sp., Phyllobacterium sp.) transfection or transformation of a plant (e.g., soybean) cell, protoplast, embryo, callus, or tissue with a nucleic acid comprising the subject synthetic polynucleotide can be used; see, e.g., Broothaerts et al. (2005) *Nature,* 433:629-633.

In some cases, an RGE, RGN, or ndRGDBP polypeptide or fusion polypeptide or RGE, RGN, or ndRGDBP system can is provided as a nucleic acid (e.g., an mRNA, a DNA, a plasmid, an expression vector, a viral vector, etc.), that encodes the RGE, RGN, or ndRGDBP polypeptide or fusion polypeptide and/or other components of the RGE, RGN, or ndRGDBP system. An RGE, RGN, or ndRGDBP polypeptide or fusion polypeptide can be introduced into a cell (provided to the cell) by any convenient method; such methods are known to those of ordinary skill in the art. As an illustrative example, a subject synthetic polynucleotide encoding the RGE, RGN, or ndRGDBP polypeptide can be injected directly into a cell (e.g., with or without an RGE, RGN, or ndRGDBP guide RNA or nucleic acid encoding an RGE, RGN, or ndRGDBP guide RNA, and with or without a donor template DNA molecule). In some cases, an RGE, RGN, or ndRGDBP fusion polypeptide (e.g., RGE, RGN, or ndRGDBP fused to a fusion partner) is provided as a nucleic acid (e.g., an mRNA, a DNA, a plasmid, an expression vector, a viral vector, etc.) comprising a subject synthetic polynucleotide encoding the RGE, RGN, or ndRGDBP fusion polypeptide.

In some cases, a nucleic acid (e.g., an RGE, RGN, or ndRGDBP guide RNA; a nucleic acid comprising a subject synthetic polynucleotide encoding an RGE, RGN, or ndRGDBP polypeptide; one or more components of an RGE, RGN, or ndRGDBP system, etc.) is delivered to a cell (e.g., a target host cell such as a soybean cell) in a particle or associated with a particle. In some cases, an RGE, RGN, or ndRGDBP system is delivered to a cell in a particle or associated with a particle. The terms "particle" and nanoparticle" can be used interchangeable, as appropriate. A recombinant expression vector comprising a subject synthetic polynucleotide encoding an RGE, RGN, or ndRGDBP polypeptide or fusion polypeptide and/or an RGE, RGN, or ndRGDBP guide RNA, an mRNA comprising a subject synthetic polynucleotide encoding an RGE, RGN, or ndRGDBP polypeptide or fusion polypeptide of the present disclosure, and guide RNA may be delivered simultaneously using particles or lipid envelopes. For instance, a subject synthetic polynucleotide encoding an RGE, RGN, or ndRGDBP polypeptide or fusion polypeptide and an RGE, RGN, or ndRGDBP guide RNA can be delivered via a particle, e.g., a delivery particle comprising lipid or lipidoid and hydrophilic polymer, e.g., a cationic lipid and a hydrophilic polymer, for instance wherein the cationic lipid comprises 1,2-dioleoyl-3-trimethylammonium-propane (DOTAP) or 1,2-ditetradecanoyl-sn-glycero-3-phosphocholine (DMPC) and/or wherein the hydrophilic polymer comprises ethylene glycol or polyethylene glycol (PEG); and/or wherein the particle further comprises cholesterol (e.g., particle from formulation1=DOTAP 100, DMPC 0, PEG 0, Cholesterol 0; formulation number 2=DOTAP 90, DMPC 0, PEG 10, Cholesterol 0; formulation number 3=DOTAP 90, DMPC 0, PEG 5, Cholesterol 5).

An mRNA comprising a subject synthetic polynucleotide encoding an RGE, RGN, or ndRGDBP polypeptide or fusion polypeptide or a recombinant expression vector comprising a subject synthetic polynucleotide encoding an RGE, RGN, or ndRGDBP polypeptide or fusion polypeptide and/or RGE, RGN, or ndRGDBP guide RNA (or a nucleic acid such as one or more expression vectors encoding the RGE, RGN, or ndRGDBP guide RNA) may be delivered simultaneously using particles or lipid envelopes. For example, a biodegradable core-shell structured nanoparticle with a poly (β-amino ester) (PBAE) core enveloped by a phospholipid bilayer shell can be used. In some cases, particles/nanoparticles based on self-assembling bioadhesive polymers are used.

Lipidoid compounds (e.g., as described in US patent application 20110293703) are also useful in the administration of polynucleotides and can be used to deliver a subject synthetic polynucleotide encoding an RGE, RGN, or ndRGDBP polypeptide or fusion polypeptide or one or more components of an RGE, RGN, or ndRGDBP system. In one aspect, the aminoalcohol lipidoid compounds are combined with an agent to be delivered to a cell or a subject to form microparticles, nanoparticles, liposomes, or micelles. The aminoalcohol lipidoid compounds may be combined with other aminoalcohol lipidoid compounds, polymers (synthetic or natural), surfactants, cholesterol, carbohydrates, proteins, lipids, etc. to form the particles.

A poly(beta-amino alcohol) (PBAA) can be used to deliver a subject synthetic polynucleotide encoding an RGE, RGN, or ndRGDBP polypeptide or fusion polypeptide or one or more components of an RGE, RGN, or ndRGDBP system to a target cell. US Patent Publication No. 20130302401 relates to a class of poly(beta-amino alcohols) (PBAAs) that has been prepared using combinatorial polymerization.

Sugar-based particles may be used, for example GalNAc, as described with reference to WO2014118272 (incorporated herein by reference) and Nair, J K et al., 2014, Journal of the American Chemical Society 136 (49), 16958-16961) can be used to deliver a subject synthetic polynucleotide encoding an RGE, RGN, or ndRGDBP polypeptide or fusion polypeptide or one or more components of an RGE, RGN, or ndRGDBP system to a target cell.

In some cases, lipid nanoparticles (LNPs) are used to deliver a subject synthetic polynucleotide encoding an RGE, RGN, or ndRGDBP polypeptide or fusion polypeptide or one or more components of an RGE, RGN, or ndRGDBP system to a target cell. Negatively charged polymers such as RNA may be loaded into LNPs at low pH values (e.g., pH 4) where the ionizable lipids display a positive charge. However, at physiological pH values, the LNPs exhibit a low surface charge compatible with longer circulation times. Four species of ionizable cationic lipids have been focused upon, namely 1,2-dilineoyl-3-dimethylammonium-propane (DLinDAP), 1,2-dilinoleyloxy-3-N,N-dimethylaminopropane (DLinDMA), 1,2-dilinoleyloxy-keto-N,N-dimethyl-3-aminopropane (DLinKDMA), and 1,2-dilinoleyl-4-(2-dimethylaminoethyl)-[1,3]-dioxolane (DLinKC2-DMA). Preparation of LNPs and is described in, e.g., Rosin et al. (2011) Molecular Therapy 19: 1286-2200). The cationic lipids 1,2-dilineoyl-3-dimethylammonium-propane (DLinDAP), 1,2-dilinoleyloxy-3-N,N-dimethylaminopropane (DLinDMA), 1,2-dilinoleyloxyketo-N,N-dimethyl-3-aminopropane (DLinKDMA), 1,2-dilinoleyl-4-(2-dimethylaminoethyl)-[1,3]-dioxolane (DLinKC2-DM A), (3-o-[2"-(methoxypolyethyleneglycol 2000) succinoyl]-1,2-dimyristoyl-sn-glycol (PEG-S-DMG), and R-3-[(.omega.-methoxy-poly(ethylene glycol)2000) carbamoyl]-1,2-dimyristyloxlpropyl-3-amine (PEG-C-DOMG) may be used. A nucleic acid (e.g., an RGE, RGN, or ndRGDBP guide RNA; a subject synthetic polynucleotide encoding an RGE, RGN, or ndRGDBP polypeptide or fusion polypeptide or one or more components of an RGE, RGN, or ndRGDBP system; etc.) may be encapsulated in LNPs containing DLinDAP, DLinDMA, DLinK-DMA, and DLinKC2-DMA (cationic lipid:DSPC:CHOL: PEGS-DMG or PEG-C-DOMG at 40:10:40:10 molar ratios). In some cases, 0.2% SP-DiOC18 is incorporated.

Spherical Nucleic Acid (SNA) constructs and other nanoparticles (particularly gold nanoparticles) can be used to deliver a nucleic acid comprising a subject synthetic polynucleotide or one or more components of an RGE, RGN, or ndRGDBP system to a target cell. See, e.g., Cutler et al., J. Am. Chem. Soc. 2011 133:9254-9257, Hao et al., Small. 2011 7:3158-3162, Zhang et al., ACS Nano. 2011 5:6962-6970, Cutler et al., J. Am. Chem. Soc. 2012 134: 1376-1391, Young et al., Nano Lett. 2012 12:3867-71, Zheng et al., Proc. Natl. Acad. Sci. USA. 2012 109: 11975-80, Mirkin, Nanomedicine 2012 7:635-638 Zhang et al., J. Am. Chem. Soc. 2012 134:16488-1691, Weintraub, Nature 2013 495: S14-S16, Choi et al., Proc. Natl. Acad. Sci. USA. 2013 110(19): 7625-7630, Jensen et al, Sci. Transl. Med. 5, 209ra152 (2013) and Mirkin, et al., Small, 10: 186-192.

Self-assembling nanoparticles with RNA comprising a subject synthetic polynucleotide encoding an RGE, RGN, or ndRGDBP polypeptide or fusion polypeptide or one or more components of an RGE, RGN, or ndRGDBP system may be constructed with polyethyleneimine (PEI) that is PEGylated with an Arg-Gly-Asp (RGD) peptide ligand attached at the distal end of the polyethylene glycol (PEG).

In general, a "nanoparticle" refers to any particle having a diameter of less than 1000 nm. In some cases, nanoparticles suitable for use in delivering nucleic acid comprising a subject synthetic polynucleotide to a target cell have a diameter of 500 nm or less, e.g., from 25 nm to 35 nm, from 35 nm to 50 nm, from 50 nm to 75 nm, from 75 nm to 100 nm, from 100 nm to 150 nm, from 150 nm to 200 nm, from 200 nm to 300 nm, from 300 nm to 400 nm, or from 400 nm to 500 nm. In some cases, nanoparticles suitable for use in delivering a nucleic acid comprising a subject synthetic polynucleotide to a target cell have a diameter of from 25 nm to 200 nm. In some cases, nanoparticles suitable for use in delivering a nucleic acid comprising a subject synthetic polynucleotide to a target cell have a diameter of 100 nm or less. In some cases, nanoparticles suitable for use in delivering a nucleic acid comprising a subject synthetic polynucleotide to a target cell have a diameter of from 35 nm to 60 nm.

Nanoparticles suitable for use in delivering a nucleic acid comprising a subject synthetic polynucleotide or one or more components of an RGE, RGN, or ndRGDBP system to a target cell may be provided in different forms, e.g., as solid nanoparticles (e.g., metal such as silver, gold, iron, titanium), non-metal, lipid-based solids, polymers), suspensions of nanoparticles, or combinations thereof. Metal, dielectric, and semiconductor nanoparticles may be prepared, as well as hybrid structures (e.g., core-shell nanoparticles). Nanoparticles made of semiconducting material may also be labeled quantum dots if they are small enough (typically below 10 nm) that quantization of electronic energy levels occurs. Such nanoscale particles are used in biomedical applications as drug carriers or imaging agents and may be adapted for similar purposes in the present disclosure.

Semi-solid and soft nanoparticles are also suitable for use in delivering a nucleic acid comprising a subject synthetic polynucleotide or one or more components of an RGE, RGN, or ndRGDBP system to a target cell. A prototype nanoparticle of semi-solid nature is the liposome.

In some cases, a liposome is used to deliver a subject synthetic polynucleotide or one or more components of an RGE, RGN, or ndRGDBP system to a target cell. Liposomes are spherical vesicle structures composed of a uni- or multilamellar lipid bilayer surrounding internal aqueous compartments and a relatively impermeable outer lipophilic phospholipid bilayer. Liposomes can be made from several different types of lipids; however, phospholipids are most commonly used to generate liposomes. Although liposome formation is spontaneous when a lipid film is mixed with an aqueous solution, it can also be expedited by applying force in the form of shaking by using a homogenizer, sonicator, or an extrusion apparatus. Several other additives may be added to liposomes in order to modify their structure and properties. For instance, either cholesterol or sphingomyelin may be added to the liposomal mixture in order to help stabilize the liposomal structure and to prevent the leakage of the liposomal inner cargo. A liposome formulation may be mainly comprised of natural phospholipids and lipids such as 1,2-distearoryl-sn-glycero-3-phosphatidyl choline (DSPC), sphingomyelin, egg phosphatidylcholines and monosialoganglioside.

A stable nucleic-acid-lipid particle (SNALP) can be used to deliver a subject synthetic polynucleotide or one or more components of an RGE, RGN, or ndRGDBP system to a target cell. The SNALP formulation may contain the lipids 3-N-[(methoxypoly(ethylene glycol) 2000) carbamoyl]-1,2-dimyristyloxy-propylamine (PEG-C-DMA), 1,2-dilinoleyloxy-N,N-dimethyl-3-aminopropane (DLinDMA), 1,2-distearoyl-sn-glycero-3-phosphocholine (DSPC) and cholesterol, in a 2:40:10:48 molar percent ratio. The SNALP liposomes may be prepared by formulating D-Lin-DMA and PEG-C-DMA with distearoylphosphatidylcholine (DSPC), Cholesterol and siRNA using a 25:1 lipid/siRNA ratio and a 48/40/10/2 molar ratio of Cholesterol/D-Lin-DMA/DSPC/PEG-C-DMA. The resulting SNALP liposomes can be about 80-100 nm in size. A SNALP may comprise synthetic cholesterol (Sigma-Aldrich, St Louis, Mo., USA), dipalmitoylphosphatidylcholine (Avanti Polar Lipids, Alabaster, Ala., USA), 3-N-[(w-methoxy poly(ethylene glycol)2000)

carbamoyl]-1,2-dimyrestyloxypropylamine, and cationic 1,2-dilinoleyloxy-3-N,Ndimethylaminopropane. A SNALP may comprise synthetic cholesterol (Sigma-Aldrich), 1,2-distearoyl-sn-glycero-3-phosphocholine (DSPC; Avanti Polar Lipids Inc.), PEG-cDMA, and 1,2-dilinoleyloxy-3-(N; N-dimethyl)aminopropane (DLinDMA).

Other cationic lipids, such as amino lipid 2,2-dilinoleyl-4-dimethylaminoethyl-[1,3]-dioxolane (DLin-KC2-DMA) can be used to deliver a subject synthetic polynucleotide or one or more components of an RGE, RGN, or ndRGDBP system to a target cell. A preformed vesicle with the following lipid composition may be contemplated: amino lipid, distearoylphosphatidylcholine (DSPC), cholesterol and (R)-2,3-bis(octadecyloxy) propyl-1-(methoxy poly(ethyleneglycol)2000)propylcarbamate (PEG-lipid) in the molar ratio 40/10/40/10, respectively, and a FVII siRNA/total lipid ratio of approximately 0.05 (w/w). To ensure a narrow particle size distribution in the range of 70-90 nm and a low polydispersity index of 0.11.+−0.0.04 (n=56), the particles may be extruded up to three times through 80 nm membranes prior to adding the guide RNA. Particles containing the highly potent amino lipid 16 may be used, in which the molar ratio of the four lipid components 16, DSPC, cholesterol and PEG-lipid (50/10/38.5/1.5) which may be further optimized to enhance in vivo activity.

Lipids may be formulated with an RGE, RGN, or ndRGDBP system or component(s) thereof or nucleic acids encoding the same to form lipid nanoparticles (LNPs). Suitable lipids include, but are not limited to, DLin-KC2-DMA4, CI 2-200 and colipids disteroylphosphatidyl choline, cholesterol, and PEG-DMG may be formulated with an RGE, RGN, or ndRGDBP system, or component thereof, of the present disclosure, using a spontaneous vesicle formation procedure. The component molar ratio may be about 50/10/38.5/1.5 (DLin-KC2-DMA or C12-200/disteroylphosphatidyl choline/cholesterol/PEG-DMG).

AN RGE, RGN, or ndRGDBP system of the present disclosure, or a component thereof, may be delivered encapsulated in PLGA microspheres such as that further described in US published applications 20130252281 and 20130245107 and 20130244279.

Supercharged proteins can be used to deliver a subject synthetic polynucleotide or one or more components of an RGE, RGN, or ndRGDBP system to a target cell. Supercharged proteins are a class of engineered or naturally-occurring proteins with unusually high positive or negative net theoretical charge. Both supernegatively and superpositively charged proteins exhibit the ability to withstand thermally or chemically induced aggregation. Superpositively charged proteins are also able to penetrate mammalian cells. Associating cargo with these proteins, such as plasmid DNA, RNA, or other proteins, can facilitate the functional delivery of these macromolecules into mammalian cells both in vitro and in vivo.

Cell Penetrating Peptides (CPPs) can be used to deliver a subject synthetic polynucleotide or one or more components of an RGE, RGN, or ndRGDBP system to a target cell. CPPs typically have an amino acid composition that either contains a high relative abundance of positively charged amino acids such as lysine or arginine or has sequences that contain an alternating pattern of polar/charged amino acids and non-polar, hydrophobic amino acids.

The present disclosure provides a modified cell (e.g., a modified plant cell or a modified soybean cell) comprising a subject synthetic polynucleotide encoding an RGE, RGN, or ndRGDBP polypeptide or fusion polypeptide or one or more components of an RGE, RGN, or ndRGDBP system.

The present disclosure provides a genetically modified cell that is genetically modified with an mRNA comprising a subject synthetic polynucleotide encoding an RGE, RGN, or ndRGDBP polypeptide or fusion polypeptide of the present disclosure. The present disclosure provides a genetically modified cell that is genetically modified with a recombinant expression vector comprising a subject synthetic polynucleotide encoding an RGE, RGN, or ndRGDBP polypeptide or fusion polypeptide of the present disclosure. The present disclosure provides a genetically modified cell (e.g., soybean cell) that is genetically modified with a recombinant expression vector comprising: a) a subject synthetic polynucleotide encoding an RGE, RGN, or ndRGDBP polypeptide or fusion polypeptide of the present disclosure; and b) a nucleotide sequence encoding an RGE, RGN, or ndRGDBP guide RNA of the present disclosure. The present disclosure provides a genetically modified cell that is genetically modified with a recombinant expression vector comprising: a) a subject synthetic polynucleotide encoding a RGE, RGN, or ndRGDBP fusion polypeptide; b) a nucleotide sequence encoding a RGE, RGN, or ndRGDBP guide RNA; and c) a nucleotide sequence encoding a donor template DNA molecule.

A cell that serves as a recipient for a subject synthetic polynucleotide encoding an RGE, RGN, or ndRGDBPRGE, RGN, or ndRGDBP polypeptide or fusion polypeptide and/or an RGE, RGN, or ndRGDBP guide RNA of the present disclosure, can be any of a variety of cells, including, e.g., in vitro cells; in vivo cells; ex vivo cells; primary cells; cancer cells; animal cells; plant cells; algal cells; fungal cells; etc. In certain embodiments, the cells are soybean cells including meristematic or embryonic soybean cells. A cell that serves as a recipient for subject synthetic polynucleotide encoding an RGE, RGN, or ndRGDBP polypeptide or fusion polypeptide and/or an RGE, RGN, or ndRGDBP guide RNA is referred to as a "host cell" or a "target cell".

Because a method that uses an RGE, RGN, or ndRGDBP polypeptide or fusion polypeptide includes binding of the RGE, RGN, or ndRGDBP polypeptide or fusion polypeptide to a particular region in a target nucleic acid (by virtue of being targeted there by an associated RGE, RGN, or ndRGDBP guide RNA), the methods are generally referred to herein as methods of binding (e.g., a method of binding a target nucleic acid). However, it is to be understood that in some cases, while a method of binding may result in nothing more than binding of the target nucleic acid, in other cases, the method can have different final results (e.g., the method can result in modification of the target nucleic acid, e.g., cleavage/methylation/etc., modulation of transcription from the target nucleic acid; modulation of translation of the target nucleic acid; genome editing; modulation of a protein associated with the target nucleic acid; isolation of the target nucleic acid; etc.).

For examples of suitable methods of obtaining or designing guide RNAs suitable for use with certain RGE, RGN, and ndRGDBP, see, for example, Pausch et al., Science 369, 333-337 (2020), as well as Jinek et al., Science. 2012 Aug. 17; 337(6096):816-21; Chylinski et al., RNA Biol. 2013 May; 10(5):726-37; Ma et al., Biomed Res Int. 2013; 2013:270805; Hou et al., Proc Natl Acad Sci USA. 2013 Sep. 24; 110(39):15644-9; Jinek et al., Elife. 2013; 2:e00471; Pattanayak et al., Nat Biotechnol. 2013 September; 31(9):839-43; Qi et al, Cell. 2013 Feb. 28; 152(5): 1173-83; Wang et al., Cell. 2013 May 9; 153(4):910-8; Auer et al, Genome Res. 2013 Oct. 31; Chen et al., Nucleic Acids Res. 2013 Nov. 1; 41(20):e19; Cheng et al., Cell Res. 2013 October; 23(10): 1163-71; Cho et al., Genetics. 2013

November; 195(3): 1177-80; DiCarlo et al., Nucleic Acids Res. 2013 April; 41(7):4336-43; Dickinson et al., Nat Methods. 2013 October; 10(10): 1028-34; Ebina et al., Sci Rep. 2013; 3:2510; Fujii et al, Nucleic Acids Res. 2013 Nov. 1; 41(20):e187; Hu et al., Cell Res. 2013 November; 23(11): 1322-5; Jiang et al., Nucleic Acids Res. 2013 Nov. 1; 41(20):e188; Larson et al, Nat Protoc. 2013 November; 8(11):2180-96; Mali et. at., Nat Methods. 2013 October; 10(10):957-63; Nakayama et al., Genesis. 2013 December; 51(12):835-43; Ran et al., Nat Protoc. 2013 November; 8(11):2281-308; Ran et al., Cell. 2013 Sep. 12; 154(6): 1380-9; Upadhyay et al., G3 (Bethesda). 2013 Dec. 9; 3(12):2233-8; Walsh et al., Proc Natl Acad Sci USA. 2013 Sep. 24; 110(39): 15514-5; Xie et al., Mol Plant. 2013 Oct. 9; Yang et al., Cell. 2013 Sep. 12; 154(6): 1370-9; and U.S. patents and patent applications: U.S. Pat. Nos. 8,906,616; 8,895,308; 8,889,418; 8,889,356; 8,871,445; 8,865,406; 8,795,965; 8,771,945; 8,697,359; 20140068797; 20140170753; 20140179006; 20140179770; 20140186843; 20140186919; 20140186958; 20140189896; 20140227787; 20140234972; 20140242664; 20140242699; 20140242700; 20140242702; 20140248702; 20140256046; 20140273037; 20140273226; 20140273230; 20140273231; 20140273232; 20140273233; 20140273234; 20140273235; 20140287939; 20140295556; 20140295557; 20140298547; 20140304853; 20140309487; 20140310828; 20140310830; 20140315985; 20140335063; 20140335620; 20140342456; 20140342457; 20140342458; 20140349400; 20140349405; 20140356867; 20140356956; 20140356958; 20140356959; 20140357523; 20140357530; 20140364333; and 20140377868; each of which is hereby incorporated by reference in its entirety.

In applications in which it is desirable to insert a polynucleotide sequence into the genome where a target sequence is cleaved, a donor template DNA molecule can also be provided to the cell. A donor template DNA molecule can be inserted at the target editing site cleaved by the RGE or RGN protein (e.g., after dsDNA cleavage, after nicking a target DNA, after dual nicking a target DNA, and the like). The donor template DNA molecule can contain sufficient homology to a genomic sequence at the target site, e.g., 70%, 80%, 85%, 90%, 95%, or 100% homology with the nucleotide sequences flanking the target site, e.g., within about 50 bases or less of the target site, e.g., within about 30 bases, within about 15 bases, within about 10 bases, within about 5 bases, or immediately flanking the target site, to support homology-directed repair between it and the genomic sequence to which it bears homology. Approximately 25, 50, 100, or 200 nucleotides, or more than 200 nucleotides, of sequence homology between a donor and a genomic sequence (or any integral value between 10 and 200 nucleotides, or more) can support homology-directed repair. Donor template DNA molecules can be of any length, e.g., 10 nucleotides or more, 50 nucleotides or more, 100 nucleotides or more, 250 nucleotides or more, 500 nucleotides or more, 1000 nucleotides or more, 5000 nucleotides or more, etc.

The donor template DNA molecule is typically not identical to the genomic sequence that it replaces. Rather, the donor template DNA molecule may contain at least one or more single base changes, insertions, deletions, inversions or rearrangements with respect to the genomic sequence, so long as sufficient homology is present to support homology-directed repair (e.g., for gene correction, e.g., to convert a disease-causing base pair to a non-disease-causing base pair). In some embodiments, a donor template DNA molecule comprises a nonhomologous sequence flanked by two regions of homology, such that homology-directed repair between the target DNA region and the two flanking sequences results in insertion of the non-homologous sequence at the target region. A donor template DNA molecule may also comprise a vector backbone containing sequences that are not homologous to the DNA region of interest and that are not intended for insertion into the DNA region of interest. Generally, the homologous region(s) of a donor template DNA molecule will have at least 50% sequence identity to a genomic sequence with which recombination is desired. In certain embodiments, 60%, 70%, 80%, 90%, 95%, 98%, 99%, or 99.9% sequence identity is present. Any value between 1% and 100% sequence identity can be present, depending upon the length of the donor template DNA molecule.

The donor template DNA molecule may comprise certain sequence differences as compared to the genomic sequence, e.g., restriction sites, nucleotide polymorphisms, selectable markers (e.g., drug resistance genes, fluorescent proteins, enzymes etc.), etc., which may be used to assess for successful insertion of the donor sequence at the cleavage site or in some cases may be used for other purposes (e.g., to signify expression at the targeted genomic locus). In some cases, if located in a coding region, such nucleotide sequence differences will not change the amino acid sequence, or will make silent amino acid changes (e.g., changes which do not affect the structure or function of the protein). Alternatively, these sequences differences may include flanking recombination sequences such as FLPs, loxP sequences, or the like, that can be activated at a later time for removal of the marker sequence.

In some cases, the donor template DNA molecule is provided to the cell as single-stranded DNA. In some cases, the donor template DNA molecule is provided to the cell as double-stranded DNA. It may be introduced into a cell in linear or circular form. If introduced in linear form, the ends of the donor sequence may be protected (e.g., from exonucleolytic degradation) by any convenient method. For example, one or more dideoxynucleotide residues can be added to the 3' terminus of a linear molecule and/or self-complementary oligonucleotides can be ligated to one or both ends. See, for example, Chang et al. (1987) Proc. Natl. Acad Sci USA 84:4959-4963; Nehls et al. (1996) Science 272:886-889. Additional methods for protecting exogenous polynucleotides from degradation include, but are not limited to, addition of terminal amino group(s) and the use of modified internucleotide linkages such as, for example, phosphorothioates, phosphor amidates, and O-methyl ribose or deoxyribose residues. As an alternative to protecting the termini of a linear donor sequence, additional lengths of sequence may be included outside of the regions of homology that can be degraded without impacting recombination. A donor template DNA molecule can be introduced into a cell as part of a vector molecule having additional sequences such as, for example, replication origins, promoters and genes encoding antibiotic resistance. Moreover, donor sequences can be introduced as naked nucleic acid, as nucleic acid complexed with an agent such as a liposome or poloxamer, or can be delivered by viruses (e.g., adenovirus, AAV, geminiviruses), as described elsewhere herein for nucleic acids encoding an RGE, RGN, or ndRGDBP guide RNA, an RGE, RGN, or ndRGDBP peptide, an RGE, RGN, or ndRGDBP fusion polypeptide, and/or donor template DNA molecule.

As described above, in some cases, a nucleic acid (e.g., a recombinant expression vector) comprising a subject synthetic polynucleotide encoding an RGE, RGN, or ndRGDBP polypeptide or an RGE, RGN, or ndRGDBP fusion polypeptide is used as a transgene to generate a transgenic plant that produces an RGE, RGN, or ndRGDBP polypeptide, or an RGE, RGN, or ndRGDBP fusion polypeptide. Transgenic plants, plant parts (e.g., seed), tissues, or transgenic plant cell, and particularly a transgenic soybean plant, soybean plant part (e.g., soybean seed), soybean tissue, or transgenic soybean plant cell comprising a subject synthetic polynucleotide encoding an RGE, RGN, or ndRGDBP polypeptide, or an RGE, RGN, or ndRGDBP fusion polypeptide are provided. In some embodiments, the genome of the transgenic plant comprises a subject synthetic polynucleotide. In some embodiments, the transgenic plant is homozygous for the genetic modification. In some embodiments, the transgenic plant is heterozygous for the genetic modification. Methods set forth in Schindele et al. (FEBS Letters 592(2018) 1954-1967) for use of Cas9 or Cas12-based RGE, RGN, or ndRGDBP in plants can be adapted for use with the subject synthetic polynucleotides provided herein.

Methods of introducing exogenous nucleic acids into plant cells are established. Such plant cells are considered "transformed," as defined above. Suitable methods include viral infection (such as double stranded DNA viruses including geminiviruses), transfection, conjugation, protoplast fusion, electroporation, particle gun technology, calcium phosphate precipitation, direct microinjection, silicon carbide whiskers technology, *Agrobacterium*-mediated transformation and the like. The choice of method is generally dependent on the type of cell being transformed and the circumstances under which the transformation is taking place (e.g., in vitro, ex vivo, or in vivo).

Transformation methods based upon the soil bacterium *Agrobacterium tumefaciens* are particularly useful for introducing an exogenous nucleic acid molecule into a vascular plant. The wild type form of *Agrobacterium* contains a Ti (tumor-inducing) plasmid that directs production of tumorigenic crown gall growth on host plants. Transfer of the tumor-inducing T-DNA region of the Ti plasmid to a plant genome requires the Ti plasmid-encoded virulence genes as well as T-DNA borders, which are a set of direct DNA repeats that delineate the region to be transferred. An *Agrobacterium*-based vector is a modified form of a Ti plasmid, in which the tumor inducing functions are replaced by the nucleic acid sequence of interest to be introduced into the plant host.

*Agrobacterium*-mediated transformation generally employs cointegrate vectors or binary vector systems, in which the components of the Ti plasmid are divided between a helper vector, which resides permanently in the *Agrobacterium* host and carries the virulence genes, and a shuttle vector, which contains the gene of interest bounded by T-DNA sequences. A variety of binary vectors is well known in the art and are commercially available, for example, from Clontech (Palo Alto, Calif.). Methods of coculturing *Agrobacterium* with cultured plant cells or wounded tissue such as leaf tissue, root explants, hypocotyledons, stem pieces or tubers, for example, also are well known in the art. See, e.g., Glick and Thompson, (eds.), Methods in Plant Molecular Biology and Biotechnology, Boca Raton, Fla.: CRC Press (1993).

Microprojectile-mediated transformation also can be used to produce a subject transgenic plant. This method, first described by Klein et al. (Nature 327:70-73 (1987)), relies on microprojectiles such as gold or tungsten that are coated with the desired nucleic acid molecule by precipitation with calcium chloride, spermidine or polyethylene glycol. The microprojectile particles are accelerated at high speed into an angiosperm tissue using a device such as the BIOLISTIC PD-1000 (Biorad; Hercules Calif.). A nucleic acid (e.g., a recombinant expression vector) comprising a subject synthetic polynucleotide encoding an RGE, RGN, or ndRGDBP polypeptide, or an RGE, RGN, or ndRGDBP fusion polypeptide may be introduced into a plant in a manner such that the nucleic acid is able to enter a plant cell(s), e.g., via an in vivo or ex vivo protocol. By "in vivo," it is meant in the nucleic acid is administered to a living body of a plant e.g., infiltration. By "ex vivo" it is meant that cells or explants are modified outside of the plant, and then such cells or organs are regenerated to a plant. A number of vectors suitable for stable transformation of plant cells or for the establishment of transgenic plants have been described, including those described in Weissbach and Weissbach, (1989) Methods for Plant Molecular Biology Academic Press, and Gelvin et al., (1990) Plant Molecular Biology Manual, Kluwer Academic Publishers. Specific examples include those derived from a Ti plasmid of *Agrobacterium tumefaciens*, as well as those disclosed by Herrera-Estrella et al. (1983) Nature 303: 209, Bevan (1984) Nucl Acid Res. 12: 8711-8721, Klee (1985) Bio/Technolo 3: 637-642. Alternatively, non-Ti vectors can be used to transfer the DNA into plants and cells by using free DNA delivery techniques. By using these methods transgenic plants such as wheat, rice (Christou (1991) Bio/Technology 9:957-9 and 4462) and corn (Gordon-Kamm (1990) Plant Cell 2: 603-618) can be produced. An immature embryo can also be a good target tissue for monocots for direct DNA delivery techniques by using the particle gun (Weeks et al. (1993) Plant Physiol 102: 1077-1084; Vasil (1993) Bio/Technolo 10: 667-674; Wan and Lemeaux (1994) Plant Physiol 104: 37-48 and for *Agrobacterium*-mediated DNA transfer (Ishida et al. (1996) Nature Biotech 14: 745-750). Methods for transforming soybean are also set forth in U.S. Patent Application Publication Nos. 20150099648, 20140283225, 20140173774, 20090077694, 20090049567, and 20080229447, which are each incorporated herein by reference in their entireties. Methods for introduction of DNA into chloroplasts are biolistic bombardment, polyethylene glycol transformation of protoplasts, and microinjection (Danieli et al Nat. Biotechnol 16:345-348, 1998; Staub et al Nat. Biotechnol 18: 333-338, 2000; O'Neill et al Plant J. 3:729-738, 1993; Knoblauch et al Nat. Biotechnol 17: 906-909; U.S. Pat. Nos. 5,451,513, 5,545,817, 5,545,818, and 5,576,198; in Intl. Application No. WO 95/16783; and in Boynton et al., Methods in Enzymology 217: 510-536 (1993), Svab et al., Proc. Natl. Acad. Sci. USA 90: 913-917 (1993), and McBride et al., Proc. Natl. Acad. Sci. USA 91: 7301-7305 (1994)). Any vector suitable for the methods of biolistic bombardment, polyethylene glycol transformation of protoplasts and microinjection will be suitable as a targeting vector for chloroplast transformation. Any double stranded DNA vector may be used as a transformation vector, especially when the method of introduction does not utilize *Agrobacterium*.

Plants which can be genetically modified include grains, forage crops, fruits, vegetables, oil seed crops, palms, forestry, and vines. Specific examples of plants which can be modified with the subject synthetic polynucleotides follow: maize, banana, peanut, field peas, sunflower, tomato, canola, tobacco, wheat, barley, oats, potato, leguminous plants including soybeans, beans, peanuts, peas, and lentils; cotton, carnations, sorghum, lupin and rice.

The present disclosure provides transformed plant cells, tissues, plants and products that contain the transformed plant cells (e.g., soybean plant cells). A feature of certain subject transformed cells, and tissues and products that include the same is the presence of a subject synthetic polynucleotide integrated into the genome, and production by plant cells of an RGE, RGN, or ndRGDBP polypeptide, or an RGE, RGN, or ndRGDBP fusion polypeptide.

Recombinant plant cells (e.g., leguminous plant cells including soybean cells) of the present disclosure are useful as populations of recombinant cells, or as a tissue, seed, whole plant, stem, fruit, leaf, root, flower, stem, tuber, grain, animal feed, a field of plants, and the like.

Subject synthetic polynucleotides encoding an RGE, RGN, or ndRGDBP polypeptide or fusion polypeptide can be under the control of (i.e., operably linked to) an unknown promoter (e.g., when the nucleic acid randomly integrates into a host cell genome) or can be under the control of (i.e., operably linked to) a known promoter. Suitable known promoters can be any known promoter and include constitutively active promoters, inducible promoters, spatially restricted and/or temporally restricted promoters, etc.

EMBODIMENTS

Various embodiments of the plant cells and methods provided herein are included in the following non-limiting list of embodiments.

Embodiment Set 1

1. A method of modifying an endogenous soybean gene in a soybean genome comprising:
   (a) introducing a guide RNA or a polynucleotide encoding a guide RNA directed to a target editing site in the endogenous soybean gene and optionally a donor template DNA molecule having homology to the target editing site into a soybean plant cell comprising a synthetic polynucleotide encoding an RNA-guided endonuclease (RGE) or RNA guided nickase (RGN), wherein said synthetic polynucleotide:
      (i) has a GC (guanine and cytosine) content greater than 47 or 48%;
      (ii) a melting temperature (Tm) greater than 89 or 90 degrees Celsius;
      (iii) a soybean codon adaptation index (sCAI) which is lower than the sCAI of a soybean codon-optimized reference polynucleotide encoding the RGE or the RGN;
      (iv) or any a combination of i, ii, and iii; and
   (b) selecting a modified soybean plant cell, soybean plant, soybean plant part, soybean tissue, or soybean callus comprising a modification of the endogenous soybean gene.
2. A method of modifying an endogenous soybean gene in a soybean genome comprising:
   (a) introducing into a soybean plant cell:
      (i) a synthetic polynucleotide encoding an RNA-guided endonuclease (RGE) or RNA guided nickase (RGN), wherein said synthetic polynucleotide has a GC (guanine and cytosine) content greater than 47 or 48%, a melting temperature (Tm) greater than 89 or 90 degrees Celsius, a soybean codon adaptation index (sCAI) which is lower than the sCAI of a soybean codon-optimized reference polynucleotide encoding the RGE or the RGN, or any combination of said GC content, said Tm, and said lower sCAI;
      (ii) a guide RNA or a polynucleotide encoding a guide RNA directed to a target editing site in the endogenous soybean gene; and optionally
      (iii) a donor template DNA molecule having homology to the target editing site; and
   (b) selecting a modified soybean plant cell, soybean plant, soybean plant part, soybean tissue, or soybean callus comprising a modification of the endogenous soybean gene.
3. The method of embodiment 1 or 2, wherein the RGE comprises a type II Cas endonuclease, a Cas9 endonuclease, a type V Cas endonuclease, a Cas12a endonuclease, a Cas12c endonuclease, a CasX endonuclease, or an engineered endonuclease.
4. The method of embodiment 1 or 2, wherein the RGN comprises a type II Cas nickase, a Cas9 nickase, a type V Cas nickase, a Cas12a nickase, a Cas12c nickase, a CasX nickase, or an engineered nickase.
5. The method of embodiment 1 or 2, wherein the RGN comprises a mutation in an HNH or RuvC-like nuclease domain, or optionally wherein said mutation is: (i) a D10A mutation in the Cas9 protein of SEQ ID NO: 1; (ii) a R1226A amino acid mutation in the FnCpf1 protein of SEQ ID NO: 25; or (iii) a R1138A mutation in the LbCpf1 protein of SEQ ID NO: 73.
6. The method of embodiment 1 or 2, wherein the synthetic polynucleotide has at least 76%, 80%, 85%, 90%, 95%, 97%, 98%, or 99% sequence identity across the entire length of any one of:
   (i) at least one, two, three, four, five, six, seven, eight, nine, or ten polynucleotides selected from the group consisting of SEQ ID NO: 3-12, and optionally a sCAI that is lower than the sCAI of the soybean codon optimized reference polynucleotide of SEQ ID NO: 2;
   (ii) at least one, two, three, four, five, six, seven, eight, nine, or ten polynucleotides selected from the group consisting of SEQ ID NO: 15-24, and optionally a sCAI that is lower than the sCAI of the soybean codon optimized reference polynucleotide of SEQ ID NO: 14;
   (iii) at least one, two, three, four, five, six, seven, eight, nine, or ten polynucleotides selected from the group consisting of SEQ ID NO: 27-36, and optionally a sCAI that is lower than the sCAI of the soybean codon optimized reference polynucleotide of SEQ ID NO: 26;
   (iv) at least one, two, three, four, five, six, seven, eight, nine, or ten polynucleotides selected from the group consisting of SEQ ID NO: 39-48, and optionally a sCAI that is lower than the sCAI of the soybean codon optimized reference polynucleotide of SEQ ID NO: 38;
   (v) at least one, two, three, four, five, six, seven, eight, nine, or ten polynucleotides selected from the group consisting of SEQ ID NO: 51-60, and optionally a sCAI that is lower than the sCAI of the soybean codon optimized reference polynucleotide of SEQ ID NO: 50;
   (vi) at least one, two, three, four, five, six, seven, eight, nine, or ten polynucleotides selected from the group consisting of SEQ ID NO: 63-72, and optionally a sCAI that is lower than the sCAI of the soybean codon optimized reference polynucleotide of SEQ ID NO: 62;
   (vii) at least one, two, three, four, five, six, seven, eight, nine, or ten polynucleotides selected from the group consisting of SEQ ID NO: 75-84, and optionally a sCAI that is lower than the sCAI of the soybean codon optimized reference polynucleotide of SEQ ID NO: 74;
(viii) at least one, two, three, four, five, six, seven, eight, nine, or ten polynucleotides selected from the group consisting of SEQ ID NO: 87-96 and optionally a sCAI that is lower than the sCAI of the soybean codon optimized reference polynucleotide of SEQ ID NO: 86; or
(ix) at least one, two, three, four, five, six, seven, eight, nine, or ten polynucleotides selected from the group consisting of SEQ ID NO: 99-108 and optionally a sCAI that is lower than the sCAI of the soybean codon optimized reference polynucleotide of SEQ ID NO: 98.

7. The method of embodiment 1 or 2, wherein the synthetic polynucleotide has a GC content greater than 48% and at least 70%, 75%, 80%, 85%, 90%, 95%, 97%, 98%, or 99% sequence identity across the entire length of any one of:
(i) at least one, two, three, four, five, six, seven, eight, nine, or ten polynucleotides selected from the group consisting of SEQ ID NO: 3-12, and optionally a sCAI that is lower than the sCAI of the soybean codon optimized reference polynucleotide of SEQ ID NO: 2;
(ii) at least one, two, three, four, five, six, seven, eight, nine, or ten polynucleotides selected from the group consisting of SEQ ID NO: 15-24, and optionally a sCAI that is lower than the sCAI of the soybean codon optimized reference polynucleotide of SEQ ID NO: 14;
(iii) at least one, two, three, four, five, six, seven, eight, nine, or ten polynucleotides selected from the group consisting of SEQ ID NO: 27-36, and optionally a sCAI that is lower than the sCAI of the soybean codon optimized reference polynucleotide of SEQ ID NO: 26;
(iv) at least one, two, three, four, five, six, seven, eight, nine, or ten polynucleotides selected from the group consisting of SEQ ID NO: 39-48, and optionally a sCAI that is lower than the sCAI of the soybean codon optimized reference polynucleotide of SEQ ID NO: 38;
(v) at least one, two, three, four, five, six, seven, eight, nine, or ten polynucleotides selected from the group consisting of SEQ ID NO: 51-60, and optionally a sCAI that is lower than the sCAI of the soybean codon optimized reference polynucleotide of SEQ ID NO: 50;
(vi) at least one, two, three, four, five, six, seven, eight, nine, or ten polynucleotides selected from the group consisting of SEQ ID NO: 63-72, and optionally a sCAI that is lower than the sCAI of the soybean codon optimized reference polynucleotide of SEQ ID NO: 62;
(vii) at least one, two, three, four, five, six, seven, eight, nine, or ten polynucleotides selected from the group consisting of SEQ ID NO: 75-84, and optionally a sCAI that is lower than the sCAI of the soybean codon optimized reference polynucleotide of SEQ ID NO: 74;
(viii) at least one, two, three, four, five, six, seven, eight, nine, or ten polynucleotides selected from the group consisting of SEQ ID NO: 87-96 and optionally a sCAI that is lower than the sCAI of the soybean codon optimized reference polynucleotide of SEQ ID NO: 86; or
(ix) at least one, two, three, four, five, six, seven, eight, nine, or ten polynucleotides selected from the group consisting of SEQ ID NO: 99-108 and optionally a sCAI that is lower than the sCAI of the soybean codon optimized reference polynucleotide of SEQ ID NO: 98.

8. The method of embodiment 1 or 2, wherein the synthetic polynucleotide has: (a) more than 80%, 85%, 90%, 95%, 97%, 98%, or 99% sequence identity across the entire length of at least one, two, or three sequences selected from the group consisting of SEQ ID NO: 3-11, and 12 and optionally a sCAI that is lower than the sCAI of a soybean codon optimized reference polynucleotide of SEQ ID NO: 2; (b) more than 80%, 85%, 90%, or 95% sequence identity across the entire length of at least two, or three sequences selected from the group consisting of SEQ ID NO: 3-12; and a melting temperature (Tm) greater than 90 degrees Celsius and optionally a sCAI that is lower than the sCAI of a soybean codon optimized reference polynucleotide of SEQ ID NO: 2; or (c) more than 80%, 85%, 90%, or 95% sequence identity across the entire length at least one, two, or three sequences selected from the group consisting of SEQ ID NO: 3-12; and a GC content greater than 48% and optionally a sCAI that is lower than the sCAI of a soybean codon optimized reference polynucleotide of SEQ ID NO: 2.

9. The method of embodiment 1 or 2, wherein the synthetic polynucleotide encodes an RGE and:
(i) the RGE is a SpCas9 endonuclease or variant thereof having at least 95%, 96%, 97%, 98%, or 99% sequence identity to SEQ ID NO:1 and the soybean codon-optimized reference polynucleotide encoding the SpCas9 endonuclease or variant thereof has at least 95%, 96%, 97%, 98%, or 99% sequence identity to SEQ ID NO: 2;
(ii) the RGE is a SaCas9 endonuclease or variant thereof having at least 95%, 96%, 97%, 98%, or 99% sequence identity to SEQ ID NO:13 and the soybean codon-optimized reference polynucleotide encoding the SaCas9 endonuclease or variant thereof has at least 95%, 96%, 97%, 98%, or 99% sequence identity to SEQ ID NO:14;
(iii) the RGE is an FnCpf1 endonuclease or variant thereof having at least 95%, 96%, 97%, 98%, or 99% sequence identity to SEQ ID NO:25 and the soybean codon-optimized reference polynucleotide encoding the FnCpf1 endonuclease or variant thereof has at least 95% sequence identity to SEQ ID NO: 26; or
(iv) the RGE is a CasJ endonuclease or variant thereof having at least 95%, 96%, 97%, 98%, or 99% sequence identity to SEQ ID NO: 37 and the soybean codon-optimized reference polynucleotide encoding the CasJ endonuclease or variant thereof has at least 95%, 96%, 97%, 98%, or 99% sequence identity to SEQ ID NO: 38.

10. The method of embodiment 1 or 2, wherein the synthetic polynucleotide encodes the RGN, has a GC content greater than 48%, and has at least 70%, 75%, 80%, 85%, 90%, 95%, 96%, 97%, 98%, or 99% sequence identity across the entire length of any one of:
(i) at least one, two, three, four, five, six, seven, eight, nine, or ten polynucleotides selected from the group consisting of SEQ ID NO: 3-12, and optionally a sCAI that is lower than the sCAI of a soybean codon optimized reference polynucleotide of SEQ ID NO: 2 which comprises one or more nucleotide insertions, deletions and/or substitutions and encodes the ndRGDBP;

(ii) at least one, two, three, four, five, six, seven, eight, nine, or ten polynucleotides selected from the group consisting of SEQ ID NO: 15-24, and optionally a sCAI that is lower than the sCAI of the soybean codon optimized reference polynucleotide of SEQ ID NO: 14 which comprises one or more nucleotide insertions, deletions and/or substitutions and encodes the RGN;

(iii) at least one, two, three, four, five, six, seven, eight, nine, or ten polynucleotides selected from the group consisting of SEQ ID NO: 27-36, and optionally a sCAI that is lower than the sCAI of the soybean codon optimized reference polynucleotide of SEQ ID NO: 26 which comprises one or more nucleotide insertions, deletions and/or substitutions and encodes the RGN;

(iv) at least one, two, three, four, five, six, seven, eight, nine, or ten polynucleotides selected from the group consisting of SEQ ID NO: 39-48, and optionally a sCAI that is lower than the sCAI of the soybean codon optimized reference polynucleotide of SEQ ID NO: 38 which comprises one or more nucleotide insertions, deletions and/or substitutions and encodes the RGN;

(v) at least one, two, three, four, five, six, seven, eight, nine, or ten polynucleotides selected from the group consisting of SEQ ID NO: 51-60, and optionally a sCAI that is lower than the sCAI of the soybean codon optimized reference polynucleotide of SEQ ID NO: 50 which comprises one or more nucleotide insertions, deletions and/or substitutions and encodes the RGN;

(vi) at least one, two, three, four, five, six, seven, eight, nine, or ten polynucleotides selected from the group consisting of SEQ ID NO: 63-72, and optionally a sCAI that is lower than the sCAI of the soybean codon optimized reference polynucleotide of SEQ ID NO: 62 which comprises one or more nucleotide insertions, deletions and/or substitutions and encodes the RGN;

(vii) at least one, two, three, four, five, six, seven, eight, nine, or ten polynucleotides selected from the group consisting of SEQ ID NO: 75-84, and optionally a sCAI that is lower than the sCAI of the soybean codon optimized reference polynucleotide of SEQ ID NO: 74 which comprises one or more nucleotide insertions, deletions and/or substitutions and encodes the RGN;

(viii) at least one, two, three, four, five, six, seven, eight, nine, or ten polynucleotides selected from the group consisting of SEQ ID NO: 87-96 and optionally a sCAI that is lower than the sCAI of the soybean codon optimized reference polynucleotide of SEQ ID NO: 86 which comprises one or more nucleotide insertions, deletions and/or substitutions and encodes the RGN; or (ix) at least one, two, three, four, five, six, seven, eight, nine, or ten polynucleotides selected from the group consisting of SEQ ID NO: 99-108 and optionally a sCAI that is lower than the sCAI of the soybean codon optimized reference polynucleotide of SEQ ID NO: 98 which comprises one or more nucleotide insertions, deletions and/or substitutions and encodes the RGN.

11. The method of embodiment 1 or 2, wherein the synthetic polynucleotide encodes the RGN and has:

(a) more than or at least 80%, 85%, 90%, 95%, 96%, 97%, 98%, or 99% sequence identity across the entire length of at least one, two, three, four, five, six, seven, eight, nine, or ten sequences selected from the group consisting of SEQ ID NO: 3-11, and 12 and optionally a sCAI that is lower than the sCAI of a soybean codon optimized reference polynucleotide of SEQ ID NO: 2 which comprises one or more nucleotide insertions, deletions and/or substitutions and encodes the RGN;

(b) more than or at least 80%, 85%, 90%, 95%, 96%, 97%, 98%, or 99% sequence identity across the entire length of at least two, three, four, five, six, seven, eight, nine, or ten sequences selected from the group consisting of SEQ ID NO: 3-12; and a melting temperature (Tm) greater than 90 degrees Celsius and optionally a sCAI that is lower than the sCAI of a soybean codon optimized reference polynucleotide of SEQ ID NO: 2 which comprises one or more nucleotide insertions, deletions and/or substitutions and encodes the RGN; or (c) more than or at least 80%, 85%, 90%, 95%, 96%, 97%, 98%, or 99% sequence identity across the entire length at least one, two, three, four, five, six, seven, eight, nine, or ten sequences selected from the group consisting of SEQ ID NO: 3-12; and a GC content greater than 48% and optionally a sCAI that is lower than the sCAI of a soybean codon optimized reference polynucleotide of SEQ ID NO: 2 which comprises one or more nucleotide insertions, deletions and/or substitutions and encodes the RGN.

12. The method of embodiment 1 or 2, wherein:

(i) the synthetic polynucleotide is a SpCas9 RGN having at least 95%, 97%, 98%, or 99% sequence identity to SEQ ID NO:1 and the soybean codon-optimized reference polynucleotide encoding the SpCas9 RGN has at least 95%, 97%, 98%, or 99% sequence identity to SEQ ID NO: 2;

(ii) the RGN is a SaCas9 RGN having at least 95%, 97%, 98%, or 99% sequence identity to SEQ ID NO:13 and the soybean codon-optimized reference polynucleotide encoding the SaCas9 ndRGDBP or variant thereof has at least 95%, 97%, 98%, or 99% sequence identity to SEQ ID NO:14;

(iii) the RGN is an FnCpf1 RGN having at least 95%, 97%, 98%, or 99% sequence identity to SEQ ID NO:25 and the soybean codon-optimized reference polynucleotide encoding the FnCpf1 RGN or variant thereof has at least 95%, 97%, 98%, or 99% sequence identity to SEQ ID NO: 26; or (iv) the RGN is a CasJ RGN having at least 95%, 97%, 98%, or 99% sequence identity to SEQ ID NO: 37 and the soybean codon-optimized reference polynucleotide encoding the CasJ RGN or variant thereof has at least 95%, 97%, 98%, or 99% sequence identity to SEQ ID NO: 38.

13. The method of any one of embodiments 1-12, wherein the synthetic polynucleotide:

(i) encodes the RGE and provides at least a 5-fold increase in the frequency of modifying the endogenous gene in a nuclear, plastid, or mitochondrial genome of the soybean plant cell in comparison to the frequency of modifying the endogenous gene in a control soybean plant cell with a control polynucleotide comprising the soybean codon-optimized reference polynucleotide encoding the RGE; or, (ii) encodes the RGN and provides at least a 2-fold increase in nicking or a nicking-related modification of an endogenous target sequence in a nuclear, plastid, or mitochondrial genome of the soybean plant cell in comparison to the in nicking or nicking-related modification of the endogenous target sequence in a control soybean plant cell comprising a control soybean codon optimized reference polynucleotide encoding the RGN.

14. The method of any one of embodiments 1-12, or 13, wherein the soybean codon-optimized reference polynucleotide has a GC content that is at least about 8%, 9%, or 10% lower than the GC content of the synthetic polynucleotide, or optionally wherein the soybean codon-optimized reference polynucleotide has a GC content that is at least about 8% to about 12% lower than the GC content of the synthetic polynucleotide.

15. A method of modifying expression of an endogenous soybean gene in a soybean genome comprising:
   (a) introducing a guide RNA or a polynucleotide encoding a guide RNA directed to a target DNA binding site in the endogenous soybean gene into a soybean plant cell comprising a synthetic polynucleotide encoding the ndRGDBP, wherein said synthetic polynucleotide:
      (i) has a GC (guanine and cytosine) content greater than 47 or 48%;
      (ii) a melting temperature (Tm) greater than 89 or 90 degrees Celsius;
      (iii) a soybean codon adaptation index (sCAI) which is lower than the sCAI of a soybean codon-optimized reference polynucleotide encoding the ndRGDBP;
      (iv) or any a combination of i, ii, and iii; and
   (b) selecting a soybean plant cell, soybean plant, soybean plant part, soybean tissue, or soybean callus wherein expression of the endogenous soybean gene has been modified.

16. A method of modifying expression of an endogenous soybean gene in a soybean genome comprising:
   (a) introducing into a soybean plant cell:
      (i) a synthetic polynucleotide encoding a protein comprising a nuclease deficient RNA-guided DNA binding protein (ndRGDBP), wherein said synthetic polynucleotide has a GC (guanine and cytosine) content greater than 47 or 48%, a melting temperature (Tm) greater than 89 or 90 degrees Celsius, a soybean codon adaptation index (sCAI) which is lower than the sCAI of a soybean codon-optimized reference polynucleotide encoding the ndRGDBP, or any combination of said GC content, Tm, and/or sCAI; and
      (ii) a guide RNA or a polynucleotide encoding a guide RNA directed to a target binding site in the endogenous soybean gene; and
   (b) selecting a modified soybean plant cell, soybean plant, soybean plant part, soybean tissue, or soybean callus wherein expression of the endogenous soybean gene has been modified.

17. The method of embodiment 16, wherein the ndRGDBP comprises a type II Cas ndRGDBP, a Cas9 ndRGDBP, a type V Cas ndRGDBP, a Cas12a ndRGDBP, a Cas12c ndRGDBP, a CasX ndRGDBP, or an engineered ndRGDBP 18. The method of embodiment 16, wherein the ndRGDBP comprises a mutation in an HNH or RuvC-like nuclease domain, or optionally wherein said mutation is: (i) a D10A and/or H840A mutation in the Cas9 protein of SEQ ID NO: 1; (ii) a D917A, E1006A, E1028A, D1255A, and/or N1257A mutation in the FnCpf1 protein of SEQ ID NO: 25; (iii) a D901A, E1128A, and/or D1298A mutation in the CasJ protein of SEQ ID NO: 37; or (iv) a D832A, E925A, and/or D1148A mutation in the LbCpf1 protein of SEQ ID NO: 73.

19. The method of embodiment 16, wherein the synthetic polynucleotide has at least 76%, 80%, 85%, 90%, 95%, 97%, 98%, or 99% sequence identity across the entire length of any one of:
   (i) at least one, two, three, four, five, six, seven, eight, nine, or ten polynucleotides selected from the group consisting of SEQ ID NO: 3-12, and optionally a sCAI that is lower than the sCAI of a soybean codon optimized reference polynucleotide of SEQ ID NO: 2 which comprises one or more nucleotide insertions, deletions and/or substitutions and encodes the ndRGDBP;
   (ii) at least one, two, three, four, five, six, seven, eight, nine, or ten polynucleotides selected from the group consisting of SEQ ID NO: 15-24, and optionally a sCAI that is lower than the sCAI of a soybean codon optimized reference polynucleotide of SEQ ID NO: 14 which comprises one or more nucleotide insertions, deletions and/or substitutions and encodes the ndRGDBP;
   (iii) at least one, two, three, four, five, six, seven, eight, nine, or ten polynucleotides selected from the group consisting of SEQ ID NO: 27-36, and optionally a sCAI that is lower than the sCAI of a soybean codon optimized reference polynucleotide of SEQ ID NO: 26 which comprises one or more nucleotide insertions, deletions and/or substitutions and encodes the ndRGDBP;
   (iv) at least one, two, three, four, five, six, seven, eight, nine, or ten polynucleotides selected from the group consisting of SEQ ID NO: 39-48, and optionally a sCAI that is lower than the sCAI of a soybean codon optimized reference polynucleotide of SEQ ID NO: 38 which comprises one or more nucleotide insertions, deletions and/or substitutions and encodes the ndRGDBP;
   (v) at least one, two, three, four, five, six, seven, eight, nine, or ten polynucleotides selected from the group consisting of SEQ ID NO: 51-60, and optionally a sCAI that is lower than the sCAI of a soybean codon optimized reference polynucleotide of SEQ ID NO: 50 which comprises one or more nucleotide insertions, deletions and/or substitutions and encodes the ndRGDBP;
   (vi) at least one, two, three, four, five, six, seven, eight, nine, or ten polynucleotides selected from the group consisting of SEQ ID NO: 63-72, and optionally a sCAI that is lower than the sCAI of a soybean codon optimized reference polynucleotide of SEQ ID NO: 62 which comprises one or more nucleotide insertions, deletions and/or substitutions and encodes the ndRGDBP;

(vii) at least one, two, three, four, five, six, seven, eight, nine, or ten polynucleotides selected from the group consisting of SEQ ID NO: 75-84, and optionally a sCAI that is lower than the sCAI of a soybean codon optimized reference polynucleotide of SEQ ID NO: 74 which comprises one or more nucleotide insertions, deletions and/or substitutions and encodes the ndRGDBP;

(viii) at least one, two, three, four, five, six, seven, eight, nine, or ten polynucleotides selected from the group consisting of SEQ ID NO: 87-96 and optionally a sCAI that is lower than the sCAI of the soybean codon optimized reference polynucleotide of SEQ ID NO: 86 which comprises one or more nucleotide insertions, deletions and/or substitutions and encodes the ndRGDBP; or (ix) at least one, two, three, four, five, six, seven, eight, nine, or ten polynucleotides selected from the group consisting of SEQ ID NO: 99-108 and optionally a sCAI that is lower than the sCAI of a soybean codon optimized reference polynucleotide of SEQ ID NO: 98 which comprises one or more nucleotide insertions, deletions and/or substitutions and encodes the ndRGDBP.

20. The method of embodiment 16, wherein the synthetic polynucleotide has a GC content greater than 48% and at least 70%, 75%, 80%, 85%, 90%, 95%, 97%, 98%, or 99% sequence identity across the entire length of any one of:

(i) at least one, two, three, four, five, six, seven, eight, nine, or ten polynucleotides selected from the group consisting of SEQ ID NO: 3-12, and optionally a sCAI that is lower than the sCAI of a soybean codon optimized reference polynucleotide of SEQ ID NO: 2 which comprises one or more nucleotide insertions, deletions and/or substitutions and encodes the ndRGDBP;

(ii) at least one, two, three, four, five, six, seven, eight, nine, or ten polynucleotides selected from the group consisting of SEQ ID NO: 15-24, and optionally a sCAI that is lower than the sCAI of the soybean codon optimized reference polynucleotide of SEQ ID NO: 14 which comprises one or more nucleotide insertions, deletions and/or substitutions and encodes the ndRGDBP;

(iii) at least one, two, three, four, five, six, seven, eight, nine, or ten polynucleotides selected from the group consisting of SEQ ID NO: 27-36, and optionally a sCAI that is lower than the sCAI of the soybean codon optimized reference polynucleotide of SEQ ID NO: 26 which comprises one or more nucleotide insertions, deletions and/or substitutions and encodes the ndRGDBP;

(iv) at least one, two, three, four, five, six, seven, eight, nine, or ten polynucleotides selected from the group consisting of SEQ ID NO: 39-48, and optionally a sCAI that is lower than the sCAI of the soybean codon optimized reference polynucleotide of SEQ ID NO: 38 which comprises one or more nucleotide insertions, deletions and/or substitutions and encodes the ndRGDBP;

(v) at least one, two, three, four, five, six, seven, eight, nine, or ten polynucleotides selected from the group consisting of SEQ ID NO: 51-60, and optionally a sCAI that is lower than the sCAI of the soybean codon optimized reference polynucleotide of SEQ ID NO: 50 which comprises one or more nucleotide insertions, deletions and/or substitutions and encodes the ndRGDBP;

(vi) at least one, two, three, four, five, six, seven, eight, nine, or ten polynucleotides selected from the group consisting of SEQ ID NO: 63-72, and optionally a sCAI that is lower than the sCAI of the soybean codon optimized reference polynucleotide of SEQ ID NO: 62 which comprises one or more nucleotide insertions, deletions and/or substitutions and encodes the ndRGDBP;

(vii) at least one, two, three, four, five, six, seven, eight, nine, or ten polynucleotides selected from the group consisting of SEQ ID NO: 75-84, and optionally a sCAI that is lower than the sCAI of the soybean codon optimized reference polynucleotide of SEQ ID NO: 74 which comprises one or more nucleotide insertions, deletions and/or substitutions and encodes the ndRGDBP;

(viii) at least one, two, three, four, five, six, seven, eight, nine, or ten polynucleotides selected from the group consisting of SEQ ID NO: 87-96 and optionally a sCAI that is lower than the sCAI of the soybean codon optimized reference polynucleotide of SEQ ID NO: 86 which comprises one or more nucleotide insertions, deletions and/or substitutions and encodes the ndRGDBP; or (ix) at least one, two, three, four, five, six, seven, eight, nine, or ten polynucleotides selected from the group consisting of SEQ ID NO: 99-108 and optionally a sCAI that is lower than the sCAI of the soybean codon optimized reference polynucleotide of SEQ ID NO: 98 which comprises one or more nucleotide insertions, deletions and/or substitutions and encodes the ndRGDBP.

21. The method of embodiment 16, wherein the synthetic polynucleotide has:

(a) more than or at least 80%, 85%, 90%, 95%, 97%, 98%, or 99% sequence identity across the entire length of at least one, two, three, four, five, six, seven, eight, nine, or ten sequences selected from the group consisting of SEQ ID NO: 3-11, and 12 and optionally a sCAI that is lower than the sCAI of a soybean codon optimized reference polynucleotide of SEQ ID NO: 2 which comprises one or more nucleotide insertions, deletions and/or substitutions and encodes the ndRGDBP;

(b) more than or at least 80%, 85%, 90%, 95%, 97%, 98%, or 99% sequence identity across the entire length of at least two, three, four, five, six, seven, eight, nine, or ten sequences selected from the group consisting of SEQ ID NO: 3-12; and a melting temperature (Tm) greater than 90 degrees Celsius and optionally a sCAI that is lower than the sCAI of a soybean codon optimized reference polynucleotide of SEQ ID NO: 2 which comprises one or more nucleotide insertions, deletions and/or substitutions and encodes the ndRGDBP; or (c) more than or at least 80%, 85%, 90%, 95%, 97%, 98%, or 99% sequence identity across the entire length at least one, two, three, four, five, six, seven, eight, nine, or ten sequences selected from the group consisting of SEQ ID NO: 3-12; and a GC content greater than 48% and optionally a sCAI that is lower than the sCAI of a soybean codon optimized reference polynucleotide of SEQ ID NO: 2 which comprises one or more nucleotide insertions, deletions and/or substitutions and encodes the ndRGDBP.

22. The method of embodiment 16, wherein:
  (i) the ndRGDBP is a SpCas9 ndRGDBP having at least 95%, 97%, 98%, or 99% sequence identity to SEQ ID NO:1 and the soybean codon-optimized reference polynucleotide encoding the SpCas9 ndRGDBP or variant thereof has at least 95%, 97%, 98%, or 99% sequence identity to SEQ ID NO: 2;
  (ii) the ndRGDBP is a SaCas9 ndRGDBP having at least 95%, 97%, 98%, or 99% sequence identity to SEQ ID NO:13 and the soybean codon-optimized reference polynucleotide encoding the SaCas9 ndRGDBP or variant thereof has at least 95%, 97%, 98%, or 99% sequence identity to SEQ ID NO: 14;
  (iii) the ndRGDBP is an FnCpf1 ndRGDBP having at least 95%, 97%, 98%, or 99% sequence identity to SEQ ID NO:25 and the soybean codon-optimized reference polynucleotide encoding the FnCpf1 ndRGDBP or variant thereof has at least 95%, 97%, 98%, or 99% sequence identity to SEQ ID NO: 26; or
  (iv) the ndRGDBP is a CasJ ndRGDBP having at least 95%, 97%, 98%, or 99% sequence identity to SEQ ID NO: 37 and the soybean codon-optimized reference polynucleotide encoding the CasJ ndRGDBP or variant thereof has at least 95%, 97%, 98%, or 99% sequence identity to SEQ ID NO: 38.
23. The method of any one of embodiments 16-22, wherein the synthetic polynucleotide further comprises an operably linked polynucleotide encoding an effector domain which modifies expression of the endogenous soybean gene.
24. The method of any one of embodiments 16-23, wherein the synthetic polynucleotide is operably linked to:
  (a) a promoter that is operable in a soybean plant cell;
  (b) a 5'untranslated (UT) sequence and/or a 3' untranslated (UT) sequence, optionally wherein the 5' UT and/or 3' UT optionally have (i) a GC (guanine and cytosine) content greater than 47 or 48%; (ii) a melting temperature (Tm) greater than 89 or 90 degrees Celsius; or a combination of (i) and (ii).
  (c) a polyadenylation sequence;
  (d) a second polynucleotide sequence encoding a nuclear localization signal (NLS), a chloroplast transit peptide (CTP), an epitope tag (ST), a transcriptional activation domain (TAD), a transcriptional repressor domain (TRD); or combination thereof; optionally wherein the second polynucleotide sequence(s) have (i) a GC (guanine and cytosine) content greater than 47 or 48%; (ii) a melting temperature (Tm) greater than 89 or 90 degrees Celsius; (iii) a soybean codon adaptation index (sCAI) which is lower than the sCAI of a second soybean codon-optimized reference polynucleotide encoding the NLS, CTP, ET, TAD, or TRD; or any combination of (i), (ii), and (iii); and/or
  (e) a third polynucleotide sequence encoding a heterologous polypeptide having an enzymatic activity that modifies target DNA; optionally wherein the third polynucleotide sequence(s) have (i) a GC (guanine and cytosine) content greater than 47 or 48%; (ii) a melting temperature (Tm) greater than 89 or 90 degrees Celsius; (iii) a soybean codon adaptation index (sCAI) which is lower than the sCAI of a third soybean codon-optimized reference polynucleotide encoding the heterologous polypeptide; or any combination of (i), (ii), and (iii).

25. The method of embodiment 24, wherein the a heterologous polypeptide encoded by the third polynucleotide sequence exhibits one or more enzymatic activities selected from: nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity, and/or glycosylase activity.
26. The method of any one of embodiments 16-25, wherein the synthetic polynucleotide provides at least a 2-fold increase in expression of the endogenous gene in a nuclear, plastid, or mitochondrial genome of the soybean plant cell in comparison to the expression of the endogenous gene in a control soybean plant cell containing a control soybean codon-optimized reference polynucleotide encoding the ndRGDBP and having: (i) a GC content that is at least about 8%, 9%, or 10% lower than the GC content of the polynucleotide, or optionally wherein the control polynucleotide encoding the ndRGDBP has a GC content that is at least about 8% to about 12% lower than the GC content of the synthetic polynucleotide.
27. The method of any one of embodiments 16-26, wherein the synthetic polynucleotide comprises an RNA molecule that encodes the RGE, RGN, or ndRGDBP.
28. A soybean plant cell comprising a synthetic polynucleotide encoding a protein comprising an RNA-guided endonuclease (RGE), an RNA-guided nickase (RGN), or a nuclease deficient RNA-guided DNA binding protein (ndRGDBP), wherein said polynucleotide has:
  (a) a GC (guanine and cytosine) content greater than 47 or 48%;
  (b) a melting temperature (Tm) greater than 89 or 90 degrees Celsius;
  (c) a soybean codon adaptation index (sCAI) which is lower than the sCAI of a soybean codon-optimized reference polynucleotide encoding the RGE; or
  (d) any combination of (a), (b), and/or (c).
29. The soybean plant cell of embodiment 28, wherein the RGE comprises a type II Cas endonuclease, a Cas9 endonuclease, a type V Cas endonuclease, a Cas12a endonuclease, a Cas12c endonuclease, a CasX endonuclease, or an engineered endonuclease.
30. The soybean plant cell of embodiment 28, wherein the ndRGDBP comprises a type II Cas ndRGDBP, a Cas9 ndRGDBP, a type V Cas ndRGDBP, a Cas12a ndRGDBP, a Cas12c ndRGDBP, a CasX ndRGDBP, or an engineered ndRGDBP.
31. The soybean plant cell of embodiment 28, wherein the synthetic polynucleotide encodes an RGE and has at least 76%, 80%, 85%, 90%, 95%, 97%, 98%, or 99% sequence identity across the entire length of any one of:
  (i) at least one, two, three, four, five, six, seven, eight, nine, or ten polynucleotides selected from the group consisting of SEQ ID NO: 3-12, and optionally a sCAI that is lower than the sCAI of the soybean codon optimized reference polynucleotide of SEQ ID NO: 2;
  (ii) at least one, two, three, four, five, six, seven, eight, nine, or ten polynucleotides selected from the group consisting of SEQ ID NO: 15-24, and optionally a sCAI that is lower than the sCAI of the soybean codon optimized reference polynucleotide of SEQ ID NO: 14;
(iii) at least one, two, three, four, five, six, seven, eight, nine, or ten polynucleotides selected from the group consisting of SEQ ID NO: 27-36, and optionally a sCAI that is lower than the sCAI of the soybean codon optimized reference polynucleotide of SEQ ID NO: 26;
(iv) at least one, two, three, four, five, six, seven, eight, nine, or ten polynucleotides selected from the group consisting of SEQ ID NO: 39-48, and optionally a sCAI that is lower than the sCAI of the soybean codon optimized reference polynucleotide of SEQ ID NO: 38;
(v) at least one, two, three, four, five, six, seven, eight, nine, or ten polynucleotides selected from the group consisting of SEQ ID NO: 51-60, and optionally a sCAI that is lower than the sCAI of the soybean codon optimized reference polynucleotide of SEQ ID NO: 50;
(vi) at least one, two, three, four, five, six, seven, eight, nine, or ten polynucleotides selected from the group consisting of SEQ ID NO: 63-72, and optionally a sCAI that is lower than the sCAI of the soybean codon optimized reference polynucleotide of SEQ ID NO: 62, SEQ ID NO: 75-84, and optionally a sCAI that is lower than the sCAI of the soybean codon optimized reference polynucleotide of SEQ ID NO: 74;
(vii) at least one, two, three, four, five, six, seven, eight, nine, or ten polynucleotides selected from the group consisting of SEQ ID NO: 87-96 and optionally a sCAI that is lower than the sCAI of the soybean codon optimized reference polynucleotide of SEQ ID NO: 86; or
(viii) at least one, two, three, four, five, six, seven, eight, nine, or ten polynucleotides selected from the group consisting of SEQ ID NO: 99-108 and optionally a sCAI that is lower than the sCAI of the soybean codon optimized reference polynucleotide of SEQ ID NO: 98.

32. The soybean plant cell of embodiment 28, wherein the synthetic polynucleotide encodes an RGE and has a GC content greater than 48% and at least 70%, 75%, 80%, 85%, 90%, 95%, 97%, 98%, or 99% sequence identity across the entire length of any one of:
(i) at least one, two, three, four, five, six, seven, eight, nine, or ten polynucleotides selected from the group consisting of SEQ ID NO: 3-12, and optionally a sCAI that is lower than the sCAI of the soybean codon optimized reference polynucleotide of SEQ ID NO: 2;
(ii) at least one, two, three, four, five, six, seven, eight, nine, or ten polynucleotides selected from the group consisting of SEQ ID NO: 15-24, and optionally a sCAI that is lower than the sCAI of the soybean codon optimized reference polynucleotide of SEQ ID NO: 14;
(iii) at least one, two, three, four, five, six, seven, eight, nine, or ten polynucleotides selected from the group consisting of SEQ ID NO: 27-36, and optionally a sCAI that is lower than the sCAI of the soybean codon optimized reference polynucleotide of SEQ ID NO: 26;
(iv) at least one, two, three, four, five, six, seven, eight, nine, or ten polynucleotides selected from the group consisting of SEQ ID NO: 39-48, and optionally a sCAI that is lower than the sCAI of the soybean codon optimized reference polynucleotide of SEQ ID NO: 38;
(v) at least one, two, three, four, five, six, seven, eight, nine, or ten polynucleotides selected from the group consisting of SEQ ID NO: 51-60, and optionally a sCAI that is lower than the sCAI of the soybean codon optimized reference polynucleotide of SEQ ID NO: 50;
(vi) at least one, two, three, four, five, six, seven, eight, nine, or ten polynucleotides selected from the group consisting of SEQ ID NO: 63-72, and optionally a sCAI that is lower than the sCAI of the soybean codon optimized reference polynucleotide of SEQ ID NO: 62, SEQ ID NO: 75-84, and optionally a sCAI that is lower than the sCAI of the soybean codon optimized reference polynucleotide of SEQ ID NO: 74;
(vii) at least one, two, three, four, five, six, seven, eight, nine, or ten polynucleotides selected from the group consisting of SEQ ID NO: 87-96 and optionally a sCAI that is lower than the sCAI of the soybean codon optimized reference polynucleotide of SEQ ID NO: 86; or
(viii) at least one, two, three, four, five, six, seven, eight, nine, or ten polynucleotides selected from the group consisting of SEQ ID NO: 99-108 and optionally a sCAI that is lower than the sCAI of the soybean codon optimized reference polynucleotide of SEQ ID NO: 98.

33. The soybean plant cell of embodiment 28, wherein the synthetic polynucleotide encodes the RGE and has:
(a) more than or at least 80%, 85%, 90%, 95%, 97%, 98%, or 99% sequence identity across the entire length of at least one, two, or three sequences selected from the group consisting of SEQ ID NO: 3-11, and 12 and optionally a sCAI that is lower than the sCAI of a soybean codon optimized reference polynucleotide of SEQ ID NO: 2;
(b) more than or at least 80%, 85%, 90%, 95%, 97%, 98%, or 99% sequence identity across the entire length of at least two, or three sequences selected from the group consisting of SEQ ID NO: 3-12; and a melting temperature (Tm) greater than 90 degrees Celsius and optionally a sCAI that is lower than the sCAI of a soybean codon optimized reference polynucleotide of SEQ ID NO: 2; or
(c) more than or at least 80%, 85%, 90%, 95%, 97%, 98%, or 99% sequence identity across the entire length at least one, two, or three sequences selected from the group consisting of SEQ ID NO: 3-12; and a GC content greater than 48% and optionally a sCAI that is lower than the sCAI of a soybean codon optimized reference polynucleotide of SEQ ID NO: 2.

34. The soybean plant cell of embodiment 28, wherein the synthetic polynucleotide encodes the RGE and:
(i) the RGE is a SpCas9 endonuclease or variant thereof having at least 95%, 97%, 98%, or 99% sequence identity to SEQ ID NO:1 and the soybean codon-optimized reference polynucleotide encoding the SpCas9 endonuclease or variant thereof has at least 95%, 97%, 98%, or 99% sequence identity to SEQ ID NO: 2;
(ii) the RGE is a SaCas9 endonuclease or variant thereof having at least 95%, 97%, 98%, or 99% sequence identity to SEQ ID NO:13 and the soybean codon-optimized reference polynucleotide encoding the SaCas9 endonuclease or variant thereof has at least 95%, 97%, 98%, or 99% sequence identity to SEQ ID NO:14;

(iii) the RGE is an FnCpf1 endonuclease or variant thereof having at least 95%, 97%, 98%, or 99% sequence identity to SEQ ID NO:25 and the soybean codon-optimized reference polynucleotide encoding the FnCpf1 endonuclease or variant thereof has at least 95%, 97%, 98%, or 99% sequence identity to SEQ ID NO: 26; or (iv) the RGE is a CasJ endonuclease or variant thereof having at least 95%, 97%, 98%, or 99% sequence identity to SEQ ID NO: 37 and the soybean codon-optimized reference polynucleotide encoding the CasJ endonuclease or variant thereof has at least 95%, 97%, 98%, or 99% sequence identity to SEQ ID NO: 38.

35. The soybean plant cell of any one of embodiments 28 to 34, or 35, wherein the synthetic polynucleotide encodes the RGE and provides at least a 5-fold increase in the efficiency of modifying an endogenous gene or locus in a nuclear, plastid, or mitochondrial genome of the soybean plant cell in comparison to the efficiency of modifying the target gene in a control soybean plant cell with a control soybean codon optimized reference polynucleotide.

36. The soybean plant cell of embodiment 28, wherein the synthetic polynucleotide encodes the RGN or the ndRGDBP and has at least 76%, 80%, 85%, 90%, 95%, 97%, 98%, or 99% sequence identity across the entire length of any one of:

(i) at least one, two, three, four, five, six, seven, eight, nine, or ten polynucleotides selected from the group consisting of SEQ ID NO: 3-12, and optionally a sCAI that is lower than the sCAI of a soybean codon optimized reference polynucleotide of SEQ ID NO: 2 which comprises one or more nucleotide insertions, deletions and/or substitutions and encodes the RGN or the ndRGDBP;

(ii) at least one, two, three, four, five, six, seven, eight, nine, or ten polynucleotides selected from the group consisting of SEQ ID NO: 15-24, and optionally a sCAI that is lower than the sCAI of a soybean codon optimized reference polynucleotide of SEQ ID NO: 14 which comprises one or more nucleotide insertions, deletions and/or substitutions and encodes the RGN or the ndRGDBP;

(iii) at least one, two, three, four, five, six, seven, eight, nine, or ten polynucleotides selected from the group consisting of SEQ ID NO: 27-36, and optionally a sCAI that is lower than the sCAI of a soybean codon optimized reference polynucleotide of SEQ ID NO: 26 which comprises one or more nucleotide insertions, deletions and/or substitutions and encodes the RGN or the ndRGDBP;

(iv) at least one, two, three, four, five, six, seven, eight, nine, or ten polynucleotides selected from the group consisting of SEQ ID NO: 39-48, and optionally a sCAI that is lower than the sCAI of a soybean codon optimized reference polynucleotide of SEQ ID NO: 38 which comprises one or more nucleotide insertions, deletions and/or substitutions and encodes the RGN or the ndRGDBP;

(v) at least one, two, three, four, five, six, seven, eight, nine, or ten polynucleotides selected from the group consisting of SEQ ID NO: 51-60, and optionally a sCAI that is lower than the sCAI of a soybean codon optimized reference polynucleotide of SEQ ID NO: 50 which comprises one or more nucleotide insertions, deletions and/or substitutions and encodes the RGN or the ndRGDBP;

(vi) at least one, two, three, four, five, six, seven, eight, nine, or ten polynucleotides selected from the group consisting of SEQ ID NO: 63-72, and optionally a sCAI that is lower than the sCAI of a soybean codon optimized reference polynucleotide of SEQ ID NO: 62 which comprises one or more nucleotide insertions, deletions and/or substitutions and encodes the RGN or ndRGDBP;

(vii) at least one, two, three, four, five, six, seven, eight, nine, or ten polynucleotides selected from the group consisting of SEQ ID NO: 75-84, and optionally a sCAI that is lower than the sCAI of a soybean codon optimized reference polynucleotide of SEQ ID NO: 74 which comprises one or more nucleotide insertions, deletions and/or substitutions and encodes the RGN or the ndRGDBP;

(viii) at least one, two, three, four, five, six, seven, eight, nine, or ten polynucleotides selected from the group consisting of SEQ ID NO: 87-96 and optionally a sCAI that is lower than the sCAI of the soybean codon optimized reference polynucleotide of SEQ ID NO: 86 which comprises one or more nucleotide insertions, deletions and/or substitutions and encodes the RGN or the ndRGDBP; or (ix) at least one, two, three, four, five, six, seven, eight, nine, or ten polynucleotides selected from the group consisting of SEQ ID NO: 99-108 and optionally a sCAI that is lower than the sCAI of a soybean codon optimized reference polynucleotide of SEQ ID NO: 98 which comprises one or more nucleotide insertions, deletions and/or substitutions and encodes the RGN or the ndRGDBP.

37. The soybean plant cell of embodiment 28, wherein the synthetic polynucleotide encodes an RGN or RGDBP, has a GC content greater than 48%. and has at least 70%, 75%, 80%, 85%, 90%, 95%, 97%, 98%, or 99% sequence identity across the entire length of any one of:

(i) at least one, two, three, four, five, six, seven, eight, nine, or ten polynucleotides selected from the group consisting of SEQ ID NO: 3-12, and optionally a sCAI that is lower than the sCAI of a soybean codon optimized reference polynucleotide of SEQ ID NO: 2 which comprises one or more nucleotide insertions, deletions and/or substitutions and encodes the RGN or the ndRGDBP;

(ii) at least one, two, three, four, five, six, seven, eight, nine, or ten polynucleotides selected from the group consisting of SEQ ID NO: 15-24, and optionally a sCAI that is lower than the sCAI of the soybean codon optimized reference polynucleotide of SEQ ID NO: 14 which comprises one or more nucleotide insertions, deletions and/or substitutions and encodes the RGN or the ndRGDBP;

(iii) at least one, two, three, four, five, six, seven, eight, nine, or ten polynucleotides selected from the group consisting of SEQ ID NO: 27-36, and optionally a sCAI that is lower than the sCAI of the soybean codon optimized reference polynucleotide of SEQ ID NO: 26 which comprises one or more nucleotide insertions, deletions and/or substitutions and encodes the RGN or the ndRGDBP;

(iv) at least one, two, three, four, five, six, seven, eight, nine, or ten polynucleotides selected from the group consisting of SEQ ID NO: 39-48, and optionally a sCAI that is lower than the sCAI of the soybean codon optimized reference polynucleotide of SEQ ID NO: 38 which comprises one or more nucleotide insertions, deletions and/or substitutions and encodes the RGN or the ndRGDBP;

(v) at least one, two, three, four, five, six, seven, eight, nine, or ten polynucleotides selected from the group consisting of SEQ ID NO: 51-60, and optionally a sCAI that is lower than the sCAI of the soybean codon optimized reference polynucleotide of SEQ ID NO: 50 which comprises one or more nucleotide insertions, deletions and/or substitutions and encodes the RGN or the ndRGDBP;

(vi) at least one, two, three, four, five, six, seven, eight, nine, or ten polynucleotides selected from the group consisting of SEQ ID NO: 63-72, and optionally a sCAI that is lower than the sCAI of the soybean codon optimized reference polynucleotide of SEQ ID NO: 62 which comprises one or more nucleotide insertions, deletions and/or substitutions and encodes the RGN or the ndRGDBP;

(vii) at least one, two, three, four, five, six, seven, eight, nine, or ten polynucleotides selected from the group consisting of SEQ ID NO: 75-84, and optionally a sCAI that is lower than the sCAI of the soybean codon optimized reference polynucleotide of SEQ ID NO: 74 which comprises one or more nucleotide insertions, deletions and/or substitutions and encodes the RGN or the ndRGDBP;

(viii) at least one, two, three, four, five, six, seven, eight, nine, or ten polynucleotides selected from the group consisting of SEQ ID NO: 87-96 and optionally a sCAI that is lower than the sCAI of the soybean codon optimized reference polynucleotide of SEQ ID NO: 86 which comprises one or more nucleotide insertions, deletions and/or substitutions and encodes the RGN or the ndRGDBP; or (ix) at least one, two, three, four, five, six, seven, eight, nine, or ten polynucleotides selected from the group consisting of SEQ ID NO: 99-108 and optionally a sCAI that is lower than the sCAI of the soybean codon optimized reference polynucleotide of SEQ ID NO: 98 which comprises one or more nucleotide insertions, deletions and/or substitutions and encodes the RGN or the ndRGDBP.

38. The soybean plant cell of embodiment 28, wherein the synthetic polynucleotide encodes the RGN or the RGDBP and has:
(a) more than or at least 80%, 85%, 90%, 95%, 97%, 98%, or 99% sequence identity across the entire length of at least one, two, three, four, five, six, seven, eight, nine, or ten sequences selected from the group consisting of SEQ ID NO: 3-11, and 12 and optionally a sCAI that is lower than the sCAI of a soybean codon optimized reference polynucleotide of SEQ ID NO: 2 which comprises one or more nucleotide insertions, deletions and/or substitutions and encodes the RGN or the ndRGDBP;
(b) more than or at least 80%, 85%, 90%, 95%, 97%, 98%, or 99% sequence identity across the entire length of at least two, three, four, five, six, seven, eight, nine, or ten sequences selected from the group consisting of SEQ ID NO: 3-12; and a melting temperature (Tm) greater than 90 degrees Celsius and optionally a sCAI that is lower than the sCAI of a soybean codon optimized reference polynucleotide of SEQ ID NO: 2 which comprises one or more nucleotide insertions, deletions and/or substitutions and encodes the RGN or the ndRGDBP; or
(c) more than or at least 80%, 85%, 90%, 95%, 97%, 98%, or 99% sequence identity across the entire length at least one, two, three, four, five, six, seven, eight, nine, or ten sequences selected from the group consisting of SEQ ID NO: 3-12; and a GC content greater than 48% and optionally a sCAI that is lower than the sCAI of a soybean codon optimized reference polynucleotide of SEQ ID NO: 2 which comprises one or more nucleotide insertions, deletions and/or substitutions and encodes the RGN or the ndRGDBP.

39. The soybean plant cell of embodiment 28, wherein:
(i) the RGN or the ndRGDBP is a SpCas9 RGN or ndRGDBP having at least 95%, 97%, 98%, or 99% sequence identity to SEQ ID NO:1 and the soybean codon-optimized reference polynucleotide encoding the SpCas9 RGN or ndRGDBP has at least 95%, 97%, 98%, or 99% sequence identity to SEQ ID NO: 2;
(ii) the RGN or the ndRGDBP is a SaCas9 RGN or the ndRGDBP having at least 95%, 97%, 98%, or 99% sequence identity to SEQ ID NO:13 and the soybean codon-optimized reference polynucleotide encoding the SaCas9 RGN or the ndRGDBP has at least 95%, 97%, 98%, or 99% sequence identity to SEQ ID NO:14;
(iii) the RGN or the ndRGDBP is an FnCpf1 RGN or the ndRGDBP having at least 95%, 97%, 98%, or 99% sequence identity to SEQ ID NO:25 and the soybean codon-optimized reference polynucleotide encoding the FnCpf1 ndRGDBP or variant thereof has at least 95%, 97%, 98%, or 99% sequence identity to SEQ ID NO: 26; or
(iv) the RGN or the ndRGDBP is a CasJ RGN or the ndRGDBP having at least 95%, 97%, 98%, or 99% sequence identity to SEQ ID NO: 37 and the soybean codon-optimized reference polynucleotide encoding the CasJ ndRGDBP or variant thereof has at least 95%, 97%, 98%, or 99% sequence identity to SEQ ID NO: 38.

40. The soybean plant cell of any one of embodiments 28, 30, 36 to 38, or 39, wherein the synthetic polynucleotide:
(i) encodes a protein comprising the ndRGDBP and provides at least a 2-fold increase or decrease in expression of an endogenous gene in a nuclear, plastid, or mitochondrial genome of the soybean plant cell in comparison to the expression of the endogenous gene in a control soybean plant cell comprising a control soybean codon optimized reference polynucleotide encoding the ndRGDBp; or
(ii) encodes the RGN and provides at least a 2-fold increase in nicking or a nicking-related modification of an endogenous target sequence in a nuclear, plastid, or mitochondrial genome of the soybean plant cell in comparison to the in nicking or nicking-related modification of the endogenous target sequence in a control soybean plant cell comprising a control soybean codon optimized reference polynucleotide encoding the RGN.

41. The soybean plant cell of any one of embodiments 28 to 39, or 40, wherein the synthetic polynucleotide comprises an RNA molecule that encodes the RNA-guided endonuclease protein or RNA-guided DNA binding protein.

42. The soybean plant cell of any one of embodiments 28 to 40, or 41, wherein the soybean plant cell further comprises a guide RNA or a polynucleotide encoding a guide RNA.

43. The soybean plant cell of any one of embodiments 28 to 41, or 42, wherein the soybean plant cell further comprises a donor template DNA molecule having homology to the target editing site.

44. The soybean plant cell of any one of embodiments 28 to 42, or 43, wherein the synthetic polynucleotide is operably linked to:
    (a) a promoter that is operable in a soybean plant cell;
    (b) a 5'untranslated (UT) sequence and/or a 3' untranslated (UT) sequence, optionally wherein the 5' UT and/or 3' UT optionally have (i) a GC (guanine and cytosine) content greater than 47 or 48%; (ii) a melting temperature (Tm) greater than 89 or 90 degrees Celsius; or a combination of (i) and (ii).
    (c) a polyadenylation sequence; and/or
    (d) a second polynucleotide sequence encoding a nuclear localization signal (NLS), a chloroplast transit peptide (CTP), an epitope tag (ET), a transcriptional activation domain (TAD), a transcriptional repressor domain (TRD); or combination thereof; optionally wherein the second polynucleotide sequence(s) have (i) a GC (guanine and cytosine) content greater than 47 or 48%; (ii) a melting temperature (Tm) greater than 89 or 90 degrees Celsius; (iii) a soybean codon adaptation index (sCAI) which is lower than the sCAI of a second soybean codon-optimized reference polynucleotide encoding the NLS, CTP, ET, TAD, or TRD; or any combination of (i), (ii), and (iii); (iii) a soybean codon adaptation index (sCAI) which is lower than the sCAI of a second soybean codon-optimized reference polynucleotide encoding the NLS, CTP, ET, TAD, or TRD; or any combination of (i), (ii), and (iii); and/or
    (e) a third polynucleotide sequence encoding a heterologous having an enzymatic activity that modifies target DNA; optionally wherein the third polynucleotide sequence(s) have (i) a GC (guanine and cytosine) content greater than 47 or 48%; (ii) a melting temperature (Tm) greater than 89 or 90 degrees Celsius; (iii) a soybean codon adaptation index (sCAI) which is lower than the sCAI of a third soybean codon-optimized reference polynucleotide encoding the heterologous polypeptide; or any combination of (i), (ii), and (iii).

45. The soybean plant cell of embodiment 44, wherein the a heterologous polypeptide encoded by the third polynucleotide sequence exhibits one or more enzymatic activities selected from: nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity, and/or glycosylase activity.

46. The soybean plant cell of any one of embodiments 28-44, or 45, wherein the ndRGDBP comprises a mutation in an HNH and/or RuvC-like nuclease domain, or optionally wherein said mutation is: (i) a D10A and/or H840A mutation in the Cas9 protein of SEQ ID NO: 1; (ii) a D917A, E1006A, E1028A, D1255A, and/or N1257A mutation in the FnCpf1 protein of SEQ ID NO: 25; (iii) a D901A, E1128A, and/or D1298A mutation in the CasJ protein of SEQ ID NO: 37; or (iv) a D832A, E925A, and/or D1148A mutation in the LbCpf1 protein of SEQ ID NO: 73.

47. The soybean plant cell of any one of embodiments 28-45, or 46, wherein the RGN comprises a mutation in an HNH or RuvC-like nuclease domain, or optionally wherein said mutation is: (i) a D10A mutation in the Cas9 protein of SEQ ID NO: 1; (ii) a R1226A amino acid mutation in the FnCpf1 protein of SEQ ID NO: 25; (iii) a R1138A mutation in the LbCpf1 protein of SEQ ID NO: 73.

48. A soybean plant, plant part, tissue, or callus tissue comprising the soybean plant cell of any one of embodiments 28 to 47.

49. The soybean plant part of embodiment 48, wherein:
    (a) the part is a stem, pod, leaf, bud, root, or seed;
    (b) the tissue is a callus, meristematic, or embryonic tissue; or
    (c) the tissue is an embryonic callus tissue.

50. A method for obtaining the soybean plant cell of any one of embodiments 28 to 47, comprising:
    (a) introducing into the soybean plant cell the synthetic polynucleotide encoding the protein comprising the RNA-guided endonuclease (RGE), the RNA-guided nickase (RGN), or the nuclease deficient RNA-guided DNA binding protein (ndRGDBP), wherein said polynucleotide has a GC (guanine and cytosine) content greater than 47 or 48%; a melting temperature (Tm) greater than 89 or 90 degrees Celsius; a soybean codon adaptation index (sCAI) which is lower than the sCAI of a soybean codon-optimized reference polynucleotide encoding the RGE; any combination of said GC content, Tm, and/or lower sCAI; and
    (b) selecting a plant cell comprising the synthetic polynucleotide.

Embodiment Set 2

1. A method of modifying an endogenous plant gene in a plant genome comprising:
    (a) introducing a guide RNA or a polynucleotide encoding a guide RNA directed to a target editing site in the endogenous plant gene and optionally a donor template DNA molecule having homology to the target editing site into a plant cell comprising a synthetic polynucleotide encoding an RNA-guided endonuclease (RGE),
        wherein said synthetic polynucleotide has at least 75%, 80%, 85%, 90%, 95%, 98%, or 99% sequence identity across the entire length of any one of SEQ ID NO: 122-131, 134-143, or 146-185, and
    (b) selecting a modified plant cell, plant, plant part, plant tissue, or plant callus comprising a modification of the endogenous plant gene.

2. The method of embodiment 1, wherein the plant is soybean, and the synthetic polynucleotide has at least 77%, 80%, 85%, 90%, 95%, 98%, or 99% sequence identity across the entire length of any one of SEQ ID NO: 122-131, 134-143, or 146-185, and (i) has a GC (guanine and cytosine) content greater than 50%;
(ii) a melting temperature (Tm) greater than 90 degrees Celsius;
(iii) a soybean codon adaptation index (sCAI) which is lower than the sCAI of a soybean codon-optimized reference polynucleotide encoding the RGE;
(iv) or any a combination of i, ii, and iii; and 3. A method of modifying an endogenous soybean genome comprising:
   (a) introducing into a soybean plant cell:
      (i) a synthetic polynucleotide encoding an RNA-guided endonuclease (RGE), wherein said synthetic polynucleotide encodes a Cas12j nuclease and has a GC (guanine and cytosine) content greater than 50%, a melting temperature (Tm) greater than 90 degrees Celsius, a soybean codon adaptation index (sCAI) which is lower than the sCAI of a soybean codon-optimized reference polynucleotide encoding the RGE, or any combination of said GC content, said Tm, and said lower sCAI;
      (ii) a guide RNA or a polynucleotide encoding a guide RNA directed to a target editing site in the endogenous soybean gene; and optionally
      (iii) a donor template DNA molecule having homology to the target editing site; and
   (b) selecting a modified soybean plant cell, soybean plant, soybean plant part, soybean tissue, or soybean callus comprising a modification of the endogenous soybean gene.

4. The method of embodiment 1 or 3, wherein the RGE comprises a sequence of at least 77%, 80%, 85%, 90%, 95%, 98%, or 99% sequence identity across the entire length of any one of SEQ ID NO: 122-131, 134-143, or 146-185.

5. The method of embodiments 2 or 3, wherein the synthetic polynucleotide:
   (i) has at least 76%, 80%, 85%, 90%, 95%, 98%, or 99% sequence identity across the entire length of any one of at least one, two, or three polynucleotides selected from the group consisting of SEQ ID NO: 122-131, and optionally a sCAI that is lower than the sCAI of the soybean codon optimized reference polynucleotide of SEQ ID NO: 121;
   (ii) has at least 76%, 80%, 85%, 90%, 95%, 98%, or 99% sequence identity across the entire length of any one of at least one, two, or three polynucleotides selected from the group consisting of SEQ ID NO: 134-143, and optionally a sCAI that is lower than the sCAI of the soybean codon optimized reference polynucleotide of SEQ ID NO: 133; or
   (iii) has at least 77%, 80%, 85%, 90%, 95%, 98%, or 99% sequence identity across the entire length of any one of at least one, two, or three polynucleotides selected from the group consisting of SEQ ID NO: 146-154, and 155, and optionally a sCAI that is lower than the sCAI of the soybean codon optimized reference polynucleotide of SEQ ID NO: 145.

6. The method of embodiments 2 or 3, wherein the synthetic polynucleotide has a GC content greater than 50% and at least 70%, 80%, 85%, 90%, 95%, 98%, or 99% sequence identity across the entire length of any one of:
   (i) at least one, two, or three polynucleotides selected from the group consisting of SEQ ID NO: 122-131, and optionally a sCAI that is lower than the sCAI of the soybean codon optimized reference polynucleotide of SEQ ID NO: 121;
   (ii) of at least one, two, or three polynucleotides selected from the group consisting of SEQ ID NO: 134-143, and optionally a sCAI that is lower than the sCAI of the soybean codon optimized reference polynucleotide of SEQ ID NO: 133; or
   (iii) at least one, two, or three polynucleotides selected from the group consisting of SEQ ID NO: 146-154, and 155, and optionally a sCAI that is lower than the sCAI of the soybean codon optimized reference polynucleotide of SEQ ID NO: 145.

7. The method of embodiments 2 or 3, wherein the synthetic polynucleotide has:
   (i) more than 80%, 85%, 90%, 95%, 98%, or 99% sequence identity across the entire length of at least one, two, or three sequences selected from the group consisting of SEQ ID NO: 122-131 and optionally a sCAI that is lower than the sCAI of a soybean codon optimized reference polynucleotide of SEQ ID NO: 121;
   (ii) more than 80%, 85%, 90%, 95%, 98%, or 99% sequence identity across the entire length of at least two, or three sequences selected from the group consisting of SEQ ID NO: 122-131; and a melting temperature (Tm) greater than 90 degrees Celsius and optionally a sCAI that is lower than the sCAI of a soybean codon optimized reference polynucleotide of SEQ ID NO: 121;
   (iii) more than 80%, 85%, 90%, 95%, 98%, or 99% sequence identity across the entire length at least one, two, or three sequences selected from the group consisting of SEQ ID NO: 122-131; and a GC content greater than 50% and optionally a sCAI that is lower than the sCAI of a soybean codon optimized reference polynucleotide of SEQ ID NO: 121;
   (iv) more than 80%, 85%, 90%, 95%, 98%, or 99% sequence identity across the entire length of at least one, two, or three sequences selected from the group consisting of SEQ ID NO: 134-143 and optionally a sCAI that is lower than the sCAI of a soybean codon optimized reference polynucleotide of SEQ ID NO: 133;
   (v) more than 80%, 85%, 90%, 95%, 98%, or 99% sequence identity across the entire length of at least two, or three sequences selected from the group consisting of SEQ ID NO: 134-143; and a melting temperature (Tm) greater than 90 degrees Celsius and optionally a sCAI that is lower than the sCAI of a soybean codon optimized reference polynucleotide of SEQ ID NO: 133;
   (vi) more than 80%, 85%, 90%, 95%, 98%, or 99% sequence identity across the entire length at least one, two, or three sequences selected from the group consisting of SEQ ID NO: 134-143; and a GC content greater than 50% and optionally a sCAI that is lower than the sCAI of a soybean codon optimized reference polynucleotide of SEQ ID NO: 133;
   (vii) more than 80%, 85%, 90%, 95%, 98%, or 99% sequence identity across the entire length of at least one, two, or three sequences selected from the group consisting of SEQ ID NO: 146-154, and 155 and optionally a sCAI that is lower than the sCAI of a soybean codon optimized reference polynucleotide of SEQ ID NO: 145;
   (viii) more than 80%, 85%, 90%, 95%, 98%, or 99% sequence identity across the entire length of at least two, or three sequences selected from the group consisting of SEQ ID NO: 146-154, and 155; and a melting temperature (Tm) greater than 90 degrees Celsius and optionally a sCAI that is lower than the sCAI of a soybean codon optimized reference polynucleotide of SEQ ID NO: 145; or (ix) more than 80%, 85%, 90%, 95%, 98%, or 99% sequence identity across the entire length at least one, two, or three sequences selected from the group consisting of SEQ ID NO: 146-154, and 155; and a GC content greater than 50% and optionally a sCAI that is lower than the sCAI of a soybean codon optimized reference polynucleotide of SEQ ID NO: 145.

8. The method of embodiments 1-3, wherein:
  (i) the RGE is a Cas12j-1 endonuclease or variant thereof having at least 95% sequence identity to SEQ ID NO: 120 and the soybean codon-optimized reference polynucleotide encoding the Cas12j-1 endonuclease or variant thereof has at least 95% sequence identity to SEQ ID NO: 121;
  (ii) the RGE is a Cas12j-2 endonuclease or variant thereof having at least 95% sequence identity to SEQ ID NO:132 and the soybean codon-optimized reference polynucleotide encoding the Cas12j-2 endonuclease or variant thereof has at least 95% sequence identity to SEQ ID NO: 133; or
  (iii) the RGE is a Cas12j-3 endonuclease or variant thereof having at least 95% sequence identity to SEQ ID NO:144 and the soybean codon-optimized reference polynucleotide encoding the Cas12j-3 endonuclease or variant thereof has at least 95% sequence identity to SEQ ID NO: 145.

9. The method of embodiments 2 or 3, wherein the soybean codon-optimized reference polynucleotide has a GC content that is at least about 8%, 9%, or 10% lower than the GC content of the synthetic polynucleotide, or optionally wherein the soybean codon-optimized reference polynucleotide has a GC content that is at least about 8% to about 12% lower than the GC content of the synthetic polynucleotide.

10. The method of embodiment 1 or 3, wherein the synthetic polynucleotide encodes an RGE and
  (i) the RGE is a Cas12j-1 endonuclease or variant thereof having at least 95% sequence identity to SEQ ID NO: 120 and the synthetic polynucleotide has more than 80%, 85%, 90%, or 95% sequence identity across the entire length of at least one, two, or three sequences selected from the group consisting of SEQ ID NO: 156-164, and 165;
  (ii) the RGE is a Cas12j-2 endonuclease or variant thereof having at least 95% sequence identity to SEQ ID NO:132 and the synthetic polynucleotide has more than 80%, 85%, 90%, or 95% sequence identity across the entire length of at least one, two, or three sequences selected from the group consisting of SEQ ID NO: 166-174, and 175; or
  (iii) the RGE is a Cas12j-3 endonuclease or variant thereof having at least 95% sequence identity to SEQ ID NO:144 and the synthetic polynucleotide has more than 80%, 85%, 90%, or 95% sequence identity across the entire length of at least one, two, or three sequences selected from the group consisting of SEQ ID NO: 176-184, and 185.

11. A method of modifying expression of an endogenous gene in a plant genome comprising:
  (a) introducing a guide RNA or a polynucleotide encoding a guide RNA directed to a target DNA binding site in the endogenous soybean gene into a plant cell comprising a synthetic polynucleotide encoding ndRGDBP, wherein said synthetic polynucleotide has at least 75%, 80%, 85%, 90%, 95%, 98%, or 99% sequence identity across the entire length of any one of SEQ ID NO: 122-131, 134-143, or 146-185, and
  (b) selecting a plant cell, plant, plant part, tissue, or plant callus wherein expression of the endogenous plant gene has been modified.

12. The method of embodiment 11, wherein the ndRGDBP comprises at least one mutation corresponding to:
  (i) residues D371, E579, D673, C640, C643, C646, C661, or C664 of SEQ ID NO: 120;
  (ii) residues D394, E606, D697, C667, C670, C673, C685, or C688 of SEQ ID NO: 132; or
  (iii) residues D413, E618, D710, C680, C683, C687, C698, or C701 of SEQ ID NO: 144.

13. The method of embodiment 12, wherein the ndRGDBP comprises at least one mutation selected from
  (i) D371A, E579A, D673A, C640A, C643A, C646A, C661A, C664A, C640S, C643S, C646S, C661S, or C664S of SEQ ID NO: 120;
  (ii) D394A, E606A, D697A, C667A, C670A, C673A, C685A, C688A, C667S, C670S, C673S, C685S, or C688S of SEQ ID NO: 132; or
  (iii) D413A, E618A, D710A, C680A, C683A, C687A, C698A, C701A, C680S, C683S, C687S, C698S, and C701S of SEQ ID NO: 144.

14. The method of embodiment 11, wherein the synthetic polynucleotide encodes an ndRGDBP and
  (i) the ndRGDBP is a Cas12j-1 endonuclease or variant thereof having at least 95% sequence identity to SEQ ID NO: 120 and the synthetic polynucleotide has more than 80%, 85%, 90%, or 95% sequence identity across the entire length of at least one, two, or three sequences selected from the group consisting of SEQ ID NO: 156-164, and 165;
  (ii) the ndRGDBP is a Cas12j-2 endonuclease or variant thereof having at least 95% sequence identity to SEQ ID NO:132 and the synthetic polynucleotide has more than 80%, 85%, 90%, or 95% sequence identity across the entire length of at least one, two, or three sequences selected from the group consisting of SEQ ID NO: 166-174, and 175; or
  (iii) the ndRGDBP is a Cas12j-3 endonuclease or variant thereof having at least 95% sequence identity to SEQ ID NO:144 and the synthetic polynucleotide has more than 80%, 85%, 90%, or 95% sequence identity across the entire length of at least one, two, or three sequences selected from the group consisting of SEQ ID NO: 176-184, and 185.

15. A method of modifying expression of an endogenous soybean gene in a soybean genome comprising:
  (a) introducing into a soybean plant cell:
    (i) a synthetic polynucleotide encoding a protein comprising a Cas12j nuclease deficient RNA-guided DNA binding protein (ndRGDBP), wherein said synthetic polynucleotide has a GC (guanine and cytosine) content greater than 50%, a melting temperature (Tm) greater than 90 degrees Celsius, a soybean codon adaptation index (sCAI) which is lower than the sCAI of a soybean codon-optimized reference polynucleotide encoding the ndRGDBP, or any combination of said GC content, Tm, and/or sCAI; and
    (ii) a guide RNA or a polynucleotide encoding a guide RNA directed to a target binding site in the endogenous soybean gene; and
(b) selecting a modified soybean plant cell, soybean plant, soybean plant part, soybean tissue, or soybean callus wherein expression of the endogenous soybean gene has been modified.

16. The method of embodiment 15, wherein the ndRGDBP comprises a mutation in a RuvC-like nuclease domain.

17. The method of embodiment 15, wherein the ndRGDBP comprises a mutation:
    (i) selected from the group consisting of D371A, E579A, D673A, C640A, C643A, C646A, C661A, C664A, C640S, C643S, C646S, C661S, and C664S of SEQ ID NO: 120;
    (ii) selected from the group consisting of D394A, E606A, D697A, C667A, C670A, C673A, C685A, C688A, C667S, C670S, C673S, C685S, and C688S of SEQ ID NO: 132; or
    (iii) selected from the group consisting of D413A, E618A, D710A, C680A, C683A, C687A, C698A, C701A, C680S, C683S, C687S, C698S, and C701S of SEQ ID NO: 144.

18. The method of embodiment 15, wherein the synthetic polynucleotide
    (i) has at least 76%, 80%, 85%, 90%, 95%, 98%, or 99% sequence identity across the entire length of any one of at least one, two, or three polynucleotides selected from the group consisting of SEQ ID NO: 122-130, and 131, and optionally a sCAI that is lower than the sCAI of the soybean codon optimized reference polynucleotide of SEQ ID NO: 121;
    (ii) has at least 76%, 80%, 85%, 90%, 95%, 98%, or 99% sequence identity across the entire length of any one of at least one, two, or three polynucleotides selected from the group consisting of SEQ ID NO: 134-142, and 143, and optionally a sCAI that is lower than the sCAI of the soybean codon optimized reference polynucleotide of SEQ ID NO: 133; or
    (iii) has at least 77%, 80%, 85%, 90%, 95%, 98%, or 99% sequence identity across the entire length of any one of at least one, two, or three polynucleotides selected from the group consisting of SEQ ID NO: 146-154, and 155, and optionally a sCAI that is lower than the sCAI of the soybean codon optimized reference polynucleotide of SEQ ID NO: 145.

19. The method of embodiment 15, wherein the synthetic polynucleotide has a GC content greater than 50% and at least 70%, 80%, 85%, 90%, 95%, 98%, or 99% sequence identity across the entire length of any one of:
    (i) at least one, two, or three polynucleotides selected from the group consisting of SEQ ID NO: 122-130, and 131, and optionally a sCAI that is lower than the sCAI of the soybean codon optimized reference polynucleotide of SEQ ID NO: 121 which comprises one or more nucleotide insertions, deletions and/or substitutions and encodes the ndRGDBP;
    (ii) of at least one, two, or three polynucleotides selected from the group consisting of SEQ ID NO: 134-142, and 143, and optionally a sCAI that is lower than the sCAI of the soybean codon optimized reference polynucleotide of SEQ ID NO: 133 which comprises one or more nucleotide insertions, deletions and/or substitutions and encodes the ndRGDBP; or
    (iii) at least one, two, or three polynucleotides selected from the group consisting of SEQ ID NO: 146-154, and 155, and optionally a sCAI that is lower than the sCAI of the soybean codon optimized reference polynucleotide of SEQ ID NO: 145 which comprises one or more nucleotide insertions, deletions and/or substitutions and encodes the ndRGDBP.

20. The method of embodiment 15, wherein the synthetic polynucleotide has:
    (i) more than 80%, 85%, 90%, 95%, 98%, or 99% sequence identity across the entire length of at least one, two, or three sequences selected from the group consisting of SEQ ID NO: 122-130, and 131 and optionally a sCAI that is lower than the sCAI of a soybean codon optimized reference polynucleotide of SEQ ID NO: 121 which comprises one or more nucleotide insertions, deletions and/or substitutions and encodes the ndRGDBP;
    (ii) more than 80%, 85%, 90%, 95%, 98%, or 99% sequence identity across the entire length of at least two, or three sequences selected from the group consisting of SEQ ID NO: 122-130, and 131; and a melting temperature (Tm) greater than 90 degrees Celsius and optionally a sCAI that is lower than the sCAI of a soybean codon optimized reference polynucleotide of SEQ ID NO: 121; which comprises one or more nucleotide insertions, deletions and/or substitutions and encodes the ndRGDBP;
    (iii) more than 80%, 85%, 90%, 95%, 98%, or 99% sequence identity across the entire length at least one, two, or three sequences selected from the group consisting of SEQ ID NO: 122-130, and 131; and a GC content greater than 50% and optionally a sCAI that is lower than the sCAI of a soybean codon optimized reference polynucleotide of SEQ ID NO: 121 which comprises one or more nucleotide insertions, deletions and/or substitutions and encodes the ndRGDBP;
    (iv) more than 80%, 85%, 90%, 95%, 98%, or 99% sequence identity across the entire length of at least one, two, or three sequences selected from the group consisting of SEQ ID NO: 134-142, and 143; and optionally a sCAI that is lower than the sCAI of a soybean codon optimized reference polynucleotide of SEQ ID NO: 133 which comprises one or more nucleotide insertions, deletions and/or substitutions and encodes the ndRGDBP;
    (v) more than 80%, 85%, 90%, 95%, 98%, or 99% sequence identity across the entire length of at least two, or three sequences selected from the group consisting of SEQ ID NO: 134-142, and 143; and a melting temperature (Tm) greater than 90 degrees Celsius and optionally a sCAI that is lower than the sCAI of a soybean codon optimized reference polynucleotide of SEQ ID NO: 133 which comprises one or more nucleotide insertions, deletions and/or substitutions and encodes the ndRGDBP;
    (vi) more than 80%, 85%, 90%, 95%, 98%, or 99% sequence identity across the entire length at least one, two, or three sequences selected from the group consisting of SEQ ID NO: 134-142, and 143; and a GC content greater than 50% and optionally a sCAI that is lower than the sCAI of a soybean codon optimized reference polynucleotide of SEQ ID NO:

133 which comprises one or more nucleotide insertions, deletions and/or substitutions and encodes the ndRGDBP;
- (vii) more than 80%, 85%, 90%, 95%, 98%, or 99% sequence identity across the entire length of at least one, two, or three sequences selected from the group consisting of SEQ ID NO: 146-154, and 155 and optionally a sCAI that is lower than the sCAI of a soybean codon optimized reference polynucleotide of SEQ ID NO: 145 which comprises one or more nucleotide insertions, deletions and/or substitutions and encodes the ndRGDBP;
- (viii) more than 80%, 85%, 90%, 95%, 98%, or 99% sequence identity across the entire length of at least two, or three sequences selected from the group consisting of SEQ ID NO: 146-154, and 155; and a melting temperature (Tm) greater than 90 degrees Celsius and optionally a sCAI that is lower than the sCAI of a soybean codon optimized reference polynucleotide of SEQ ID NO: 145 which comprises one or more nucleotide insertions, deletions and/or substitutions and encodes the ndRGDBP; or
- (ix) more than 80%, 85%, 90%, 95%, 98%, or 99% sequence identity across the entire length at least one, two, or three sequences selected from the group consisting of SEQ ID NO: 146-154, and 155; and a GC content greater than 50% and optionally a sCAI that is lower than the sCAI of a soybean codon optimized reference polynucleotide of SEQ ID NO: 145 which comprises one or more nucleotide insertions, deletions and/or substitutions and encodes the ndRGDBP.

21. The method of embodiment 15:
    - (i) the ndRGDBP is a Cas12j-1 variant having at least 95% sequence identity to SEQ ID NO: 120 and the synthetic polynucleotide has more than 80%, 85%, 90%, or 95% sequence identity across the entire length of at least one, two, or three sequences selected from the group consisting of SEQ ID NO: 122-131, 156-164, and 165;
    - (ii) the ndRGDBP is a Cas12j-2 variant having at least 95% sequence identity to SEQ ID NO: 132 and the synthetic polynucleotide has more than 80%, 85%, 90%, or 95% sequence identity across the entire length of at least one, two, or three sequences selected from the group consisting of SEQ ID NO: 134-143, 166-174, and 175; or
    - (iii) the ndRGDBP is a Cas12j-3 variant having at least 95% sequence identity to SEQ ID NO: 144 and the synthetic polynucleotide has more than 80%85%, 90%, or 95% sequence identity across the entire length of at least one, two, or three sequences selected from the group consisting of SEQ ID NO: 146-155, 176-184, and 185.

22. The method of embodiments 11 or 15, wherein the synthetic polynucleotide further comprises an operably linked polynucleotide encoding an effector domain which modifies expression of the endogenous soybean gene.

23. The method of embodiments 11 or 15, wherein the synthetic polynucleotide is operably linked to:
    - (a) a promoter that is operable in a soybean plant cell;
    - (b) a 5' untranslated (UT) sequence and/or a 3' untranslated (UT) sequence, optionally wherein the 5' UT and/or 3' UT optionally have (i) a GC (guanine and cytosine) content greater than 50%; (ii) a melting temperature (Tm) greater than 90 degrees Celsius; or a combination of (i) and (ii);
    - (c) a polyadenylation sequence;
    - (d) a second polynucleotide sequence encoding a nuclear localization signal (NLS), a chloroplast transit peptide (CTP), an epitope tag (ST), a transcriptional activation domain (TAD), a transcriptional repressor domain (TRD); or combination thereof; optionally wherein the second polynucleotide sequence(s) have (i) a GC (guanine and cytosine) content greater than 50%; (ii) a melting temperature (Tm) greater than 90 degrees Celsius; (iii) a soybean codon adaptation index (sCAI) which is lower than the sCAI of a second soybean codon-optimized reference polynucleotide encoding the NLS, CTP, ET, TAD, or TRD; or any combination of (i), (ii), and (iii); and/or
    - (e) a third polynucleotide sequence encoding a heterologous polypeptide having an enzymatic activity that modifies target DNA; optionally wherein the third polynucleotide sequence(s) have (i) a GC (guanine and cytosine) content greater than 50%; (ii) a melting temperature (Tm) greater than 90 degrees Celsius; (iii) a soybean codon adaptation index (sCAI) which is lower than the sCAI of a third soybean codon-optimized reference polynucleotide encoding the heterologous polypeptide; or any combination of (i), (ii), and (iii).

24. The method of embodiment 23, wherein the a heterologous polypeptide encoded by the third polynucleotide sequence exhibits one or more enzymatic activities selected from: nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity, and/or glycosylase activity.

25. The method of embodiments 11 or 15, wherein the synthetic polynucleotide provides at least a 2-fold increase in expression of the endogenous gene in a nuclear, plastid, or mitochondrial genome of the soybean plant cell in comparison to the expression of the endogenous gene in a control soybean plant cell containing a control soybean codon-optimized reference polynucleotide encoding the ndRGDBP and having: (i) a GC content that is at least about 8%, 9%, or 10% lower than the GC content of the polynucleotide, or optionally wherein the control polynucleotide encoding the ndRGDBP has a GC content that is at least about 8% to about 12% lower than the GC content of the synthetic polynucleotide.

26. The method of embodiments 11 or 15, wherein the synthetic polynucleotide comprises an RNA molecule that encodes the ndRGDBP.

27. A plant cell comprising a synthetic polynucleotide encoding a protein comprising an RNA-guided endonuclease (RGE), or a nuclease deficient RNA-guided DNA binding protein (ndRGDBP), wherein said polynucleotide has at least 75%, 80%, 85%, 90%, 95%, 98%, or 99% sequence identity across the entire length of any one of SEQ ID NO: 122-131, 134-143, or 146-185, optionally wherein the plant cell is a monocot plant cell, and optionally wherein the monocot plant cell is a corn plant cell.

28. A soybean plant cell comprising a synthetic polynucleotide encoding a protein comprising a Cas12j RNA-guided endonuclease (RGE), or a nuclease deficient Cas12j RNA-guided DNA binding protein (ndRGDBP), wherein said polynucleotide has:
   (a) a GC (guanine and cytosine) content greater than 50%;
   (b) a melting temperature (Tm) greater than 90 degrees Celsius;
   (c) a soybean codon adaptation index (sCAI) which is lower than the sCAI of a soybean codon-optimized reference polynucleotide encoding the RGE; or
   (d) any combination of (a), (b), and/or (c).

29. The soybean plant cell of embodiment 28, wherein the synthetic polynucleotide encodes an RNA-guided DNA binding protein (ndRGDBP) comprises at least one mutation of
   (i) residues D371, E579, D673, C640, C643, C646, C661, and C664 of SEQ ID NO: 120;
   (ii) residues D394, E606, D697, C667, C670, C673, C685, and C688 of SEQ ID NO: 132; or
   (iii) residues D413, E618, D710, C680, C683, C687, C698, and C701 of SEQ ID NO: 144.

30. The soybean plant cell of embodiment 28, wherein the synthetic polynucleotide encodes an RGE and
   (i) has at least 76%, 80%, 85%, 90%, 95%, 98%, or 99% sequence identity across the entire length of any one of at least one, two, or three polynucleotides selected from the group consisting of SEQ ID NO: 122-131, and optionally a sCAI that is lower than the sCAI of the soybean codon optimized reference polynucleotide of SEQ ID NO: 121;
   (ii) has at least 76%, 80%, 85%, 90%, 95%, 98%, or 99% sequence identity across the entire length of any one of at least one, two, or three polynucleotides selected from the group consisting of SEQ ID NO: 134-143, and optionally a sCAI that is lower than the sCAI of the soybean codon optimized reference polynucleotide of SEQ ID NO: 133;
   (iii) has at least 77%, 80%, 85%, 90%, 95%, 98%, or 99% sequence identity across the entire length of any one of at least one, two, or three polynucleotides selected from the group consisting of SEQ ID NO: 146-154, and 155, and optionally a sCAI that is lower than the sCAI of the soybean codon optimized reference polynucleotide of SEQ ID NO: 145; or
   (iv) has at least 75%, 80%, 85%, 90%, 95%, 98%, or 99% sequence identity across the entire length of any one of SEQ ID NO: 146-185.

31. The soybean plant cell of embodiment 28, wherein the synthetic polynucleotide has a GC content greater than 50% and at least 70%, 80%, 85%, 90%, 95%, 98%, or 99% sequence identity across the entire length of any one of:
   (i) at least one, two, or three polynucleotides selected from the group consisting of SEQ ID NO: 122-130, and 131, and optionally a sCAI that is lower than the sCAI of the soybean codon optimized reference polynucleotide of SEQ ID NO: 121;
   (ii) of at least one, two, or three polynucleotides selected from the group consisting of SEQ ID NO: 134-142, and 143, and optionally a sCAI that is lower than the sCAI of the soybean codon optimized reference polynucleotide of SEQ ID NO: 133; or
   (iii) at least one, two, or three polynucleotides selected from the group consisting of SEQ ID NO: 146-154, and 155, and optionally a sCAI that is lower than the sCAI of the soybean codon optimized reference polynucleotide of SEQ ID NO: 145.

32. The soybean plant cell of embodiment 28, wherein the synthetic polynucleotide has:
   (i) more than 80%, 85%, 90%, 95%, 98%, or 99% sequence identity across the entire length of at least one, two, or three sequences selected from the group consisting of SEQ ID NO: 122-130, and 131 and optionally a sCAI that is lower than the sCAI of a soybean codon optimized reference polynucleotide of SEQ ID NO: 121;
   (ii) more than 80%, 85%, 90%, 95%, 98%, or 99% sequence identity across the entire length of at least two, or three sequences selected from the group consisting of SEQ ID NO: 122-130, and 131; and a melting temperature (Tm) greater than 90 degrees Celsius and optionally a sCAI that is lower than the sCAI of a soybean codon optimized reference polynucleotide of SEQ ID NO: 121;
   (iii) more than 80%, 85%, 90%, 95%, 98%, or 99% sequence identity across the entire length at least one, two, or three sequences selected from the group consisting of SEQ ID NO: 122-130, and 131; and a GC content greater than 50% and optionally a sCAI that is lower than the sCAI of a soybean codon optimized reference polynucleotide of SEQ ID NO: 121;
   (iv) more than 80%, 85%, 90%, 95%, 98%, or 99% sequence identity across the entire length of at least one, two, or three sequences selected from the group consisting of SEQ ID NO: 134-142, and 143 and optionally a sCAI that is lower than the sCAI of a soybean codon optimized reference polynucleotide of SEQ ID NO: 133;
   (v) more than 80%, 85%, 90%, 95%, 98%, or 99% sequence identity across the entire length of at least two, or three sequences selected from the group consisting of SEQ ID NO: 134-142, and 143; and a melting temperature (Tm) greater than 90 degrees Celsius and optionally a sCAI that is lower than the sCAI of a soybean codon optimized reference polynucleotide of SEQ ID NO: 133;
   (vi) more than 80%, 85%, 90%, 95%, 98%, or 99% sequence identity across the entire length at least one, two, or three sequences selected from the group consisting of SEQ ID NO: 134-142, and 143; and a GC content greater than 50% and optionally a sCAI that is lower than the sCAI of a soybean codon optimized reference polynucleotide of SEQ ID NO: 133;
   (vii) more than 80%, 85%, 90%, 95%, 98%, or 99% sequence identity across the entire length of at least one, two, or three sequences selected from the group consisting of SEQ ID NO: 146-154, and 155 and optionally a sCAI that is lower than the sCAI of a soybean codon optimized reference polynucleotide of SEQ ID NO: 145;
   (viii) more than 80%, 85%, 90%, 95%, 98%, or 99% sequence identity across the entire length of at least two, or three sequences selected from the group consisting of SEQ ID NO: 146-154, and 155; and a melting temperature (Tm) greater than 90 degrees Celsius and optionally a sCAI that is lower than the sCAI of a soybean codon optimized reference polynucleotide of SEQ ID NO: 145; or
   (ix) more than 80%, 85%, 90%, 95%, 98%, or 99% sequence identity across the entire length at least one, two, or three sequences selected from the group consisting of SEQ ID NO: 146-154, and 155; and a GC content greater than 50% and optionally a sCAI that is lower than the sCAI of a soybean codon optimized reference polynucleotide of SEQ ID NO: 145.

33. The soybean plant cell of embodiment 28, wherein the synthetic polynucleotide encodes the RGE and:
   (i) the RGE is a Cas12j-1 endonuclease or variant thereof having at least 95% sequence identity to SEQ ID NO:120 and the soybean codon-optimized reference polynucleotide encoding the Cas12j-1 endonuclease or variant thereof has at least 95% sequence identity to SEQ ID NO: 121;
   (ii) the RGE is a Cas12j-2 endonuclease or variant thereof having at least 95% sequence identity to SEQ ID NO:132 and the soybean codon-optimized reference polynucleotide encoding the Cas12j-2 endonuclease or variant thereof has at least 95% sequence identity to SEQ ID NO: 133; or
   (iii) the RGE is a Cas12j-3 endonuclease or variant thereof having at least 95% sequence identity to SEQ ID NO: 144 and the soybean codon-optimized reference polynucleotide encoding the Cas12j-3 endonuclease or variant thereof has at least 95% sequence identity to SEQ ID NO: 145.

34. The soybean plant cell of any one of embodiments 28 to 33, wherein the synthetic polynucleotide encodes the RGE and provides at least a 2-fold increase in the efficiency of modifying an endogenous gene or locus in a nuclear, plastid, or mitochondrial genome of the soybean plant cell in comparison to the efficiency of modifying the target gene in a control soybean plant cell with a control soybean codon optimized reference polynucleotide.

35. The soybean plant cell of embodiment 28, wherein the synthetic polynucleotide encodes the ndRGDBP and has at least 76%, 80%, 85%, 90%, 95%, 98%, or 99% sequence identity across the entire length of any one of:
   (i) at least one, two, or three sequences selected from the group consisting of SEQ ID NO: 122-130, and 131; and optionally a sCAI that is lower than the sCAI of a soybean codon optimized reference polynucleotide of SEQ ID NO: 121 which comprises one or more nucleotide insertions, deletions and/or substitutions and encodes the ndRGDBP;
   (ii) at least two, or three sequences selected from the group consisting of SEQ ID NO: 122-130, and 131; and a melting temperature (Tm) greater than 90 degrees Celsius and optionally a sCAI that is lower than the sCAI of a soybean codon optimized reference polynucleotide of SEQ ID NO: 121 which comprises one or more nucleotide insertions, deletions and/or substitutions and encodes the ndRGDBP;
   (iii) at least one, two, or three sequences selected from the group consisting of SEQ ID NO: 122-130, and 131; and a GC content greater than 50% and optionally a sCAI that is lower than the sCAI of a soybean codon optimized reference polynucleotide of SEQ ID NO: 121 which comprises one or more nucleotide insertions, deletions and/or substitutions and encodes the ndRGDBP;
   (iv) at least one, two, or three sequences selected from the group consisting of SEQ ID NO: 134-142, and 143; and optionally a sCAI that is lower than the sCAI of a soybean codon optimized reference polynucleotide of SEQ ID NO: 133 which comprises one or more nucleotide insertions, deletions and/or substitutions and encodes the ndRGDBP;
   (v) at least two, or three sequences selected from the group consisting of SEQ ID NO: 134-142, and 143; and a melting temperature (Tm) greater than 90 degrees Celsius and optionally a sCAI that is lower than the sCAI of a soybean codon optimized reference polynucleotide of SEQ ID NO: 133 which comprises one or more nucleotide insertions, deletions and/or substitutions and encodes the ndRGDBP;
   (vi) at least one, two, or three sequences selected from the group consisting of SEQ ID NO: 134-142, and 143; and a GC content greater than 50% and optionally a sCAI that is lower than the sCAI of a soybean codon optimized reference polynucleotide of SEQ ID NO: 133 which comprises one or more nucleotide insertions, deletions and/or substitutions and encodes the ndRGDBP;
   (vii) at least one, two, or three sequences selected from the group consisting of SEQ ID NO: 146-154, and 155 and optionally a sCAI that is lower than the sCAI of a soybean codon optimized reference polynucleotide of SEQ ID NO: 145 which comprises one or more nucleotide insertions, deletions and/or substitutions and encodes the ndRGDBP;
   (viii) at least two, or three sequences selected from the group consisting of SEQ ID NO:146-154, and 155; and a melting temperature (Tm) greater than 90 degrees Celsius and optionally a sCAI that is lower than the sCAI of a soybean codon optimized reference polynucleotide of SEQ ID NO: 145 which comprises one or more nucleotide insertions, deletions and/or substitutions and encodes the ndRGDBP; or
   (ix) at least one, two, or three sequences selected from the group consisting of SEQ ID NO:146-154, and 155; and a GC content greater than 50% and optionally a sCAI that is lower than the sCAI of a soybean codon optimized reference polynucleotide of SEQ ID NO: 145 which comprises one or more nucleotide insertions, deletions and/or substitutions and encodes the ndRGDBP.

36. The soybean plant cell of embodiment 28, wherein the synthetic polynucleotide encodes an RGDBP, has a GC content greater than 50% and has at least 70%, 80%, 85%, 90%, 95%, 98%, or 99% sequence identity across the entire length of any one of:
   (i) at least one, two, or three sequences selected from the group consisting of SEQ ID NO: 122-130, and 131; and optionally a sCAI that is lower than the sCAI of a soybean codon optimized reference polynucleotide of SEQ ID NO: 121 which comprises one or more nucleotide insertions, deletions and/or substitutions and encodes the ndRGDBP;
   (ii) at least two, or three sequences selected from the group consisting of SEQ ID NO: 122-130, and 131; and a melting temperature (Tm) greater than 90 degrees Celsius and optionally a sCAI that is lower than the sCAI of a soybean codon optimized reference polynucleotide of SEQ ID NO: 121 which comprises one or more nucleotide insertions, deletions and/or substitutions and encodes the ndRGDBP;
   (iii) at least one, two, or three sequences selected from the group consisting of SEQ ID NO: 122-130, and 131; and a GC content greater than 50% and optionally a sCAI that is lower than the sCAI of a soybean codon optimized reference polynucleotide of SEQ ID NO: 121 which comprises one or more nucleotide insertions, deletions and/or substitutions and encodes the ndRGDBP;

(iv) at least one, two, or three sequences selected from the group consisting of SEQ ID NO: 134-142, and 143; and optionally a sCAI that is lower than the sCAI of a soybean codon optimized reference polynucleotide of SEQ ID NO: 133 which comprises one or more nucleotide insertions, deletions and/or substitutions and encodes the ndRGDBP;

(v) at least two, or three sequences selected from the group consisting of SEQ ID NO: 134-142, and 143; and a melting temperature (Tm) greater than 90 degrees Celsius and optionally a sCAI that is lower than the sCAI of a soybean codon optimized reference polynucleotide of SEQ ID NO: 133 which comprises one or more nucleotide insertions, deletions and/or substitutions and encodes the ndRGDBP;

(vi) at least one, two, or three sequences selected from the group consisting of SEQ ID NO: 134-142, and 143; and a GC content greater than 50% and optionally a sCAI that is lower than the sCAI of a soybean codon optimized reference polynucleotide of SEQ ID NO: 133 which comprises one or more nucleotide insertions, deletions and/or substitutions and encodes the ndRGDBP;

(vii) at least one, two, or three sequences selected from the group consisting of SEQ ID NO: 146-154, and 155; and optionally a sCAI that is lower than the sCAI of a soybean codon optimized reference polynucleotide of SEQ ID NO: 145 which comprises one or more nucleotide insertions, deletions and/or substitutions and encodes the ndRGDBP;

(viii) at least two, or three sequences selected from the group consisting of SEQ ID NO:146-154, and 155; and a melting temperature (Tm) greater than 90 degrees Celsius and optionally a sCAI that is lower than the sCAI of a soybean codon optimized reference polynucleotide of SEQ ID NO: 145 which comprises one or more nucleotide insertions, deletions and/or substitutions and encodes the ndRGDBP; or (ix) at least one, two, or three sequences selected from the group consisting of SEQ ID NO: 146-154, and 155; and a GC content greater than 50% and optionally a sCAI that is lower than the sCAI of a soybean codon optimized reference polynucleotide of SEQ ID NO: 145 which comprises one or more nucleotide insertions, deletions and/or substitutions and encodes the ndRGDBP.

37. The soybean plant cell of embodiment 28, wherein the synthetic polynucleotide encodes the RGDBP and has:

(i) more than 80%, 85%, 90%, 95%, 98%, or 99% sequence identity across the entire length of at least one, two, or three sequences selected from the group consisting of SEQ ID NO: 122-130, and 131 and optionally a sCAI that is lower than the sCAI of a soybean codon optimized reference polynucleotide of SEQ ID NO: 121 which comprises one or more nucleotide insertions, deletions and/or substitutions and encodes the ndRGDBP;

(ii) more than 80%, 85%, 90%, 95%, 98%, or 99% sequence identity across the entire length at least two, or three sequences selected from the group consisting of SEQ ID NO: 122-130, and 131; and a melting temperature (Tm) greater than 90 degrees Celsius and optionally a sCAI that is lower than the sCAI of a soybean codon optimized reference polynucleotide of SEQ ID NO: 121 which comprises one or more nucleotide insertions, deletions and/or substitutions and encodes the ndRGDBP;

(iii) more than 80%, 85%, 90%, 95%, 98%, or 99% sequence identity across the entire length at least one, two, or three sequences selected from the group consisting of SEQ ID NO: 122-130, and 131; and a GC content greater than 50% and optionally a sCAI that is lower than the sCAI of a soybean codon optimized reference polynucleotide of SEQ ID NO: 121 which comprises one or more nucleotide insertions, deletions and/or substitutions and encodes the ndRGDBP;

(iv) more than 80%, 85%, 90%, 95%, 98%, or 99% sequence identity across the entire length of at least one, two, or three sequences selected from the group consisting of SEQ ID NO: 134-142, and 143 and optionally a sCAI that is lower than the sCAI of a soybean codon optimized reference polynucleotide of SEQ ID NO: 133 which comprises one or more nucleotide insertions, deletions and/or substitutions and encodes the ndRGDBP;

(v) more than 80%, 85%, 90%, 95%, 98%, or 99% sequence identity across the entire length of at least two, or three sequences selected from the group consisting of SEQ ID NO: 134-142, and 143 and a melting temperature (Tm) greater than 90 degrees Celsius and optionally a sCAI that is lower than the sCAI of a soybean codon optimized reference polynucleotide of SEQ ID NO: 133 which comprises one or more nucleotide insertions, deletions and/or substitutions and encodes the ndRGDBP;

(vi) more than 80%, 85%, 90%, 95%, 98%, or 99% sequence identity across the entire length at least one, two, or three sequences selected from the group consisting of SEQ ID NO: 134-142, and 143; and a GC content greater than 50% and optionally a sCAI that is lower than the sCAI of a soybean codon optimized reference polynucleotide of SEQ ID NO: 133 which comprises one or more nucleotide insertions, deletions and/or substitutions and encodes the ndRGDBP;

(vii) more than 80%, 85%, 90%, 95%, 98%, or 99% sequence identity across the entire length of at least one, two, or three sequences selected from the group consisting of SEQ ID NO: 146-154, and 155 and optionally a sCAI that is lower than the sCAI of a soybean codon optimized reference polynucleotide of SEQ ID NO: 145 which comprises one or more nucleotide insertions, deletions and/or substitutions and encodes the ndRGDBP;

(viii) more than 80%, 85%, 90%, 95%, 98%, or 99% sequence identity across the entire length of at least two, or three sequences selected from the group consisting of SEQ ID NO: 146-154, and 155 and a melting temperature (Tm) greater than 90 degrees Celsius and optionally a sCAI that is lower than the sCAI of a soybean codon optimized reference polynucleotide of SEQ ID NO: 145 which comprises one or more nucleotide insertions, deletions and/or substitutions and encodes the ndRGDBP; or (ix) more than 80%, 85%, 90%, 95%, 98%, or 99% sequence identity across the entire length at least one, two, or three sequences selected from the group consisting of SEQ ID NO: 146-154, and 155 and a GC content greater than 48% and optionally a sCAI that is lower than the sCAI of a soybean codon optimized reference polynucleotide of SEQ ID NO: 145 which comprises one or more nucleotide insertions, deletions and/or substitutions and encodes the ndRGDBP.

38. The soybean plant cell of embodiment 29, wherein:
   (i) the ndRGDBP is a Cas12j-1 ndRGDBP having at least 95% sequence identity to SEQ ID NO: 120 and the soybean codon-optimized reference polynucleotide encoding the Cas12j-1 ndRGDBP has at least 95% sequence identity to SEQ ID NO: 121;
   (ii) the ndRGDBP is a Cas12j-2 ndRGDBP having at least 95% sequence identity to SEQ ID NO: 132 and the soybean codon-optimized reference polynucleotide encoding the Cas12j-2 ndRGDBP has at least 95% sequence identity to SEQ ID NO: 133; or
   (iii) the ndRGDBP is a Cas12j-3 ndRGDBP having at least 95% sequence identity to SEQ ID NO: 144 and the soybean codon-optimized reference polynucleotide encoding the Cas12j-3 ndRGDBP has at least 95% sequence identity to SEQ ID NO: 145.

39. The soybean plant cell of any one of embodiments 28, 29, 35 to 37, or 38, wherein the synthetic polynucleotide encodes a protein comprising the ndRGDBP and provides at least a 2-fold increase or decrease in expression of an endogenous gene in a nuclear, plastid, or mitochondrial genome of the soybean plant cell in comparison to the expression of the endogenous gene in a control soybean plant cell comprising a control soybean codon optimized reference polynucleotide encoding the ndRGDBP.

40. The soybean plant cell of any one of embodiments 28 to 33, 34 to 37, or 38, wherein the synthetic polynucleotide comprises an RNA molecule that encodes the RNA-guided endonuclease protein or RNA-guided DNA binding protein.

41. The soybean plant cell of any one of embodiments 28 to 33, 35 to 37, or 38, wherein the soybean plant cell further comprises a guide RNA or a polynucleotide encoding a guide RNA.

42. The soybean plant cell of any one of embodiments 28 to 33, 35 to 37, or 38, wherein the soybean plant cell further comprises a donor template DNA molecule having homology to the target editing site.

43. The soybean plant cell of any one of embodiments 28 to 33, 35 to 37, or 38, wherein the synthetic polynucleotide is operably linked to:
   (a) a promoter that is operable in a soybean plant cell;
   (b) a 5' untranslated (UT) sequence and/or a 3' untranslated (UT) sequence, optionally wherein the 5' UT and/or 3' UT optionally have (i) a GC (guanine and cytosine) content greater than 50%; (ii) a melting temperature (Tm) greater than 90 degrees Celsius; or a combination of (i) and (ii).
   (c) a polyadenylation sequence; and/or
   (d) a second polynucleotide sequence encoding a nuclear localization signal (NLS), a chloroplast transit peptide (CTP), an epitope tag (ET), a transcriptional activation domain (TAD), a transcriptional repressor domain (TRD); or combination thereof; optionally wherein the second polynucleotide sequence(s) have (i) a GC (guanine and cytosine) content greater than 50%; (ii) a melting temperature (Tm) greater than 90 degrees Celsius; (iii) a soybean codon adaptation index (sCAI) which is lower than the sCAI of a second soybean codon-optimized reference polynucleotide encoding the NLS, CTP, ET, TAD, or TRD; or any combination of (i), (ii), and (iii); (iii) a soybean codon adaptation index (sCAI) which is lower than the sCAI of a second soybean codon-optimized reference polynucleotide encoding the NLS, CTP, ET, TAD, or TRD; or any combination of (i), (ii), and (iii); and/or
   (e) a third polynucleotide sequence encoding a heterologous having an enzymatic activity that modifies target DNA; optionally wherein the third polynucleotide sequence(s) have (i) a GC (guanine and cytosine) content greater than 50%; (ii) a melting temperature (Tm) greater than 90 degrees Celsius; (iii) a soybean codon adaptation index (sCAI) which is lower than the sCAI of a third soybean codon-optimized reference polynucleotide encoding the heterologous polypeptide; or any combination of (i), (ii), and (iii).

44. The soybean plant cell of embodiment 43, wherein the a heterologous polypeptide encoded by the third polynucleotide sequence exhibits one or more enzymatic activities selected from: nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity, and/or glycosylase activity.

45. The soybean plant cell of any one of embodiments 28, 29, 35 to 37, or 38, wherein the ndRGDBP comprises at least one mutation corresponding to:
   (i) residues D371, E579, D673, C640, C643, C646, C661, or C664 of SEQ ID NO: 120;
   (ii) residues D394, E606, D697, C667, C670, C673, C685, or C688 of SEQ ID NO: 132; or
   (iii) residues D413, E618, D710, C680, C683, C687, C698, or C701 of SEQ ID NO: 144.

46. The soybean plant cell of any one of embodiments 28, 29, 35 to 37, or 38, wherein the ndRGDBP comprises:
   (i) SEQ ID NO: 120 with a mutation selected from the group consisting of C640A, C643A, C646A, C661A, C664A, C640S, C643S, C646S, C661S, and C664S;
   (ii) SEQ ID NO: 132 with a mutation selected from the group consisting of C667A, C670A, C673A, C685A, C688A, C667S, C670S, C673S, C685S, and C688S; or
   (iii) SEQ ID NO: 144 with a mutation selected from the group consisting of C680A, C683A, C687A, C698A, C701A, C680S, C683S, C687S, C698S, and C701S.

47. A soybean plant, plant part, tissue, or callus tissue comprising the soybean plant cell of any one of embodiments 28 to 33, 35 to 37, or 38.

48. The soybean plant part of embodiment 47, wherein:
   (a) the part is a stem, pod, leaf, bud, root, or seed;
   (b) the tissue is a callus, meristematic, or embryonic tissue; or
   (c) the tissue is an embryonic callus tissue.

49. A method for obtaining the soybean plant cell of any one of embodiments 28 to 33, 35 to 37, or 38 comprising:

(a) introducing into the soybean plant cell the synthetic polynucleotide encoding the protein comprising the Cas12j RNA-guided endonuclease (RGE) or the Cas12j nuclease deficient RNA-guided DNA binding protein (ndRGDBP), wherein said polynucleotide has a GC (guanine and cytosine) content greater than 50%; a melting temperature (Tm) greater than 90 degrees Celsius; a soybean codon adaptation index (sCAI) which is lower than the sCAI of a soybean codon-optimized reference polynucleotide encoding the RGE; any combination of said GC content, Tm, and/or lower sCAI; and (b) selecting a plant cell comprising the synthetic polynucleotide.

50. An isolated polynucleotide comprising any one of SEQ ID NO: 122-131, 134-143, or 146-185.

51. An isolated polynucleotide encoding a Cas12j polypeptide comprising a mutation or a residue corresponding to:
   (a) C640 of SEQ ID NO: 120, C667 of SEQ ID NO: 132, or C680 of SEQ ID NO: 144;
   (b) C643 of SEQ ID NO: 120, C670 of SEQ ID NO: 132, or C683 of SEQ ID NO: 144;
   (c) C646 of SEQ ID NO: 120, C673 of SEQ ID NO: 132, or C687 of SEQ ID NO: 144;
   (d) C661 of SEQ ID NO: 120, C685 of SEQ ID NO: 132, or C698 of SEQ ID NO: 144; or
   (e) C664 of SEQ ID NO: 120, C688 of SEQ ID NO: 132, or C701 of SEQ ID NO: 144.

52. An isolated polynucleotide encoding a polypeptide comprising:
   (a) SEQ ID NO: 120 with a mutation selected from the group consisting of C640A, C643A, C646A, C661A, C664A, C640S, C643S, C646S, C661S, and C664S;
   (b) SEQ ID NO: 132 with a mutation selected from the group consisting of C667A, C670A, C673A, C685A, C688A, C667S, C670S, C673S, C685S, and C688S; or
   (c) SEQ ID NO: 144 with a mutation selected from the group consisting of C680A, C683A, C687A, C698A, C701A, C680S, C683S, C687S, C698S, and C701S.

53. A recombinant nucleic acid comprising an isolated nucleic acid according to embodiments 50, 51, or 52.

EXAMPLES

The following examples are not intended to limit the scope of the claims.

Example 1—Cas Synthetic Sequence Construction and Expression Levels in Soybean Cells Two Cas nuclease-expressing vectors encoding the same RGN polypeptide, but using different codons, were synthesized. The soybean codon-optimized reference polynucleotide sequence of Cas Soy 1.1.1 which encodes the RGN contains codons assigned according to the conventional soybean codon usage table (FIG. 1; from the world wide web internet site "kazusa.or.jp/codon/cgi-bin/showcodon.cgi?species=3847") using the OPTIMIZER program (Puigbo P., Guzmen E. Romeu A. and Garcia-Vallve S. 2007 OPTIMIZER: A web server for optimizing the codon usage of DNA sequences. Nucleic Acids Research, 35:W126-W131) and has a GC content of about 37.5%. The test Cas Soy 1.1.S subject synthetic polynucleotide sequence which encodes the RGN contains codons which are not assigned according to the conventional soybean codon usage table and has a GC content of about 49.5%. The control reference Cas Soy 1.1.1 and the test Cas Soy 1.1.1S coding sequences were inserted into otherwise identical plant expression cassettes.

The expression vectors were transfected into soy protoplasts under similar conditions. Immuno-blot (i.e., "Western blot") probing for the expressed Cas polypeptides reveals a higher level of expression for the test Cas Soy 1.1.1S subject synthetic polynucleotide sequence in comparison to the Cas Soy 1.1.1 soybean codon-optimized reference polynucleotide (FIG. 2).

Example 2—Performance of Cas Expression Vectors in Tomato and Soy Protoplasts

Figure 3:
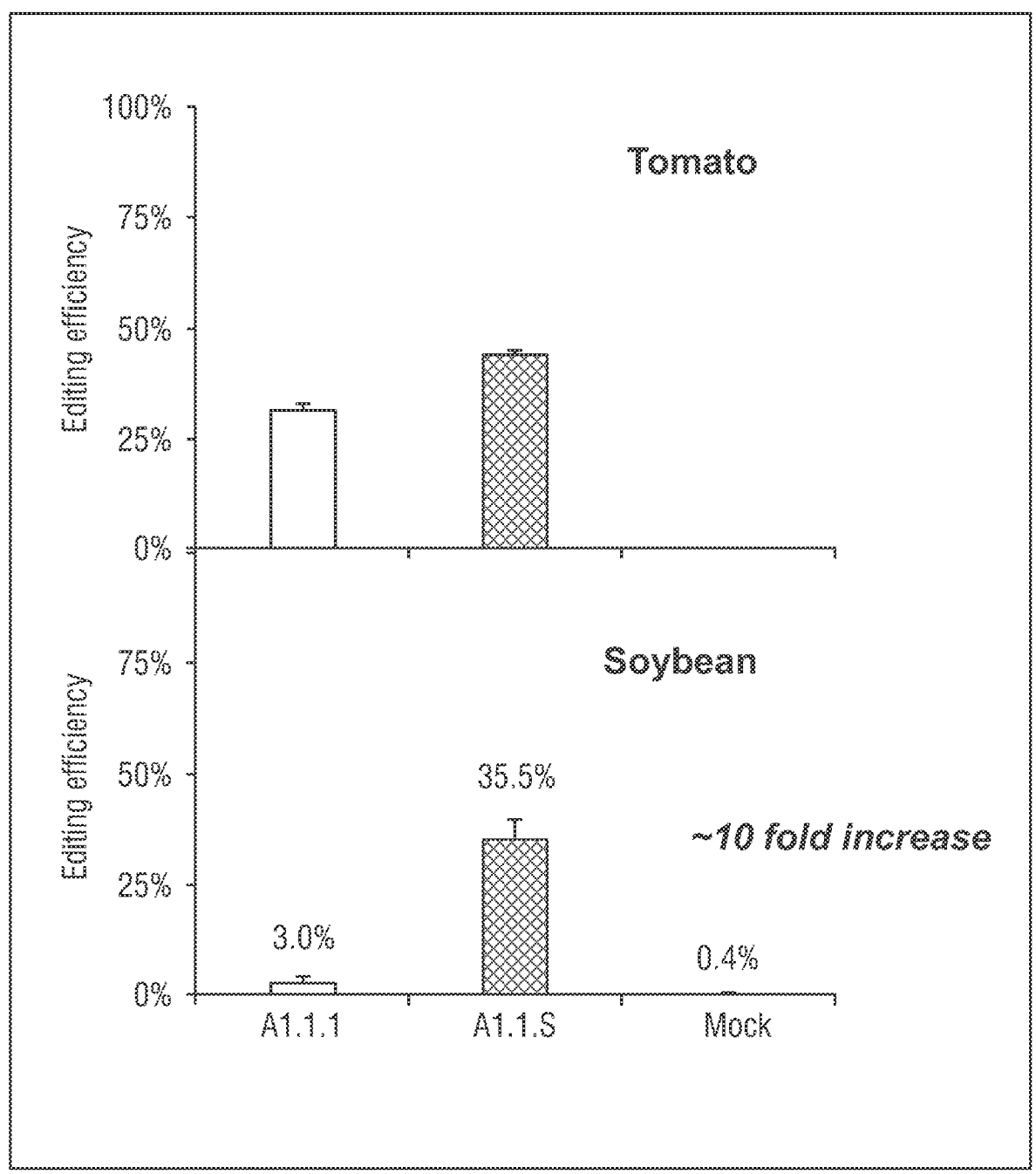
FIG. 3 shows genomic editing efficiencies in tomato and soybean protoplasts transformed with dicot-optimized (left) and soybean-optimized (center) expression vectors. A mock transfected negative control is at right.

Cas expression vectors comprising the soybean codon-optimized reference polynucleotide sequence of Cas Soy 1.1.1 or the subject synthetic polynucleotide sequence of Cas Soy 1.1.1S and each further comprising an expression cassette for an RNA guide directed to a tomato genomic site, were transfected into tomato protoplasts. The Cas Soy 1.1.1 or the Cas Soy 1.1.1S expression vectors, each further comprising an expression cassette for an RNA guide directed to a soybean genomic site, were also transfected into soybean protoplasts. DNA of the transfected protoplasts is extracted after treatment, and the editing efficiency at the target sites is quantified. Cas Soy 1.1.5 increases the editing efficiency over Cas Soy 1.1.1 about 10-fold (FIG. 3).

Example 3—Cas Synthetic Sequence Construction and Expression Levels in Soybean Cells Two Cas nuclease-expressing vectors encoding the same RGE polypeptide of SEQ ID NO: 132, but using different codons, are synthesized. A soybean codon-optimized reference polynucleotide sequence of Cas12j-2 which encodes the RGE contains codons assigned according to the conventional soybean codon usage table (FIG. 1; from the world wide web inter site "kazusa.or.jp/codon/cgi-bin/showcodon.cgi?species=3847") using the OPTIMIZER program (Puigbo P., Guzmen E. Romeu A. and Garcia-Vallve S. 2007 OPTIMIZER: A web server for optimizing the codon usage of DNA sequences. Nucleic Acids Research, 35:W126-W131) and has a GC content of about 48.7% (SEQ ID NO: 133). A test Cas12j-2 subject synthetic polynucleotide sequence which encodes the RGE contains codons which are not assigned according to the conventional soybean codon usage table and has a GC content of about 58.4% (SEQ ID NO: 137). The control reference and the test Cas12j-2 coding sequences are inserted into otherwise identical plant expression cassettes.

The expression vectors are transfected into soy protoplasts under similar conditions. Immuno-blot (i.e., "Western blot") probing for the expressed Cas polypeptides show a higher level of expression for the test Cas 12j-2 subject synthetic polynucleotide sequence in comparison to the reference Cas12j-2 polynucleotide.

Example 4—Increase in Editing Efficiency

Cas expression vectors comprising the soybean codon-optimized reference polynucleotide sequence of Cas12j-2 or the subject synthetic polynucleotide sequence of Cas Cas12j-2 and each further comprising an expression cassette for an RNA guide directed to a soybean genomic site, are transfected into soybean protoplasts. DNA of the transfected protoplasts is extracted after treatment, and the editing efficiency at the target sites is quantified. The expressed subject synthetic polynucleotide shows higher editing efficiency than the reference polynucleotide.

Although the foregoing disclosure has been described in some detail by way of illustration and example for purposes of clarity of understanding, it will be clear that certain changes and modifications may be practiced within the scope of the appended claims.

SEQUENCE LISTING (188 sequences)

SEQ ID NO: 1 - protein, 1368 aa, Streptococcus pyogenes [sequence omitted]

SEQ ID NO: 2 - DNA, 4104 bp, Artificial
  synthetic
atggacaagaaatattctatagggctggacattgggacaaacagtgtcgggtgggcagtgattaccgatgaatacaaggtaccatcaaaaaaatttaaggtcctcggcaacacagatcgccactccattaagaaaaatttgattggtgctctcttgttcgacagtggcgagactgccgaagctacacgtctgaagagaaccgccagacgccgctatacccgtaggaaaaacagaatctgttacctccaggaaattttttctaacgagatggctaaggtggacgactcattctttcacaggctggaggaatcctttcttgtcgaagaagataagaagcacgagaggcacccaatcttcggcaatattgttgatgaggtggcctaccacgaaaaatatcctactatctatcacttgagaaagaaactcgtcgactctaccgacaaagcagatctgcgtctcatttatctggcacttgcacacatgatcaagttccgtgggcatttcttgattgagggggatttgaaccctgataactctgatgtagataagctgtttattcagctggtccagacctacaaccagctgtttgaagagaaccctataaatgcttcaggagttgatgctaaggctatcctcagcgcacgcctgtcaaaaagcaggagacttgagaaccttatcgctcagctcccaggggagaaaaaaaatggcctgtttggcaatctgatcgcactctcattgggcttgacacctaacttcaaaagtaatttcgatctcgctgaggacgcaaaactgcaactgtctaaggatacttacgatgacgacctcgacaacttgctcgcccagataggagaccagtatgccgatctcttcttggcagccaaaaatttgagtgacgcaatccttttgtctgatattctgcgcgttaatactgagataactaaggctcctctctctgctagcatgattaagaggtacgacgaacaccatcaagatcttacccttctcaaggccctcgtgcgccaacagctgccagagaaatataaggagattttcttcgaccagtcaaagaacggctacgcaggctacatagacgggggggctagccaggaggaattctacaagttcatcaagcccatccttgaaaagatggatggcacagaggaactgttggtcaagctgaacagggaagaccttctcagaaaacaaaggactttcgacaacggaagcatacctcaccaaatccatttgggggaattgcatgctatacttaggcgccaagaagacttctatcccttcttgaaggacaatcgtgagaaaatagagaagatccttacattcagaattccatactacgtcgggcctctggccagaggaaattcccgttttgcttggatgactcgtaaatctgaagagaccataacaccctggaatttcgaagaagttgtagataagggggcttctgctcagagtttcatcgaaagaatgacaaatttcgataagaacttgcctaatgagaaagtattgccaaaacactctcttctttatgagtactttaccgtctataacgaattgactaaggtcaaatatgttaccgaaggcatgaggaaacccgcctttttgtcaggggagcagaagaaagcaatcgtcgatctcctgtttaaaactaataggaaagttacagttaagcagttgaaggaagattatttcaaaaagattgaatgttttgattctgtggaaatctctggagtagaggatcgctttaatgccagcttggggacataccatgatctgcttaaaattatcaaggacaaagattttctggacaatgaagaaaatgaggacatcctggaagatatagttctgactttgaccttgtttgaggatagagaaatgatagaggaaagactcaaaacttatgctcatttgttcgacgacaaggttatgaagcaactgaaaaggcgtagatataccgggtggggacgcttgagtagaaaattgatcaacggcataagggataaacagagcggcaagaccattcttgatttcttgaaatcagatggctttgccaaccgcaacttcatgcaactgatccacgacgatagtcttacttttaaagaggatatccagaaggcccaagtctcagggcaaggggacagcctgcacgaacacatagccaacctcgctggctctcctgcaattaagaagggaatccttcagacagtaaaggtcgtggacgagcttgtgaaggtaatggggcgccacaagccagaaaacatcgtgattgaaatggcaagggaaaaccagaccacccagaaaggacaaaagaacagtagggagcgcatgaagcgcatagaagaagggattaaagagctcgggtcccaaatcctcaaggagcatcccgtagaaaatacacaacttcagaatgagaagctgtacctgtactacctgcaaaacggtagagatatgtacgtagatcaagaactcgacatcaaccgcttgtctgattatgacgtggaccacatcgtccctcagtctttccttaaggacgactctattgataacaaggttctgacaaggagcgacaagaataggggcaagtccgacaatgtgccctctgaagaggtcgtaaagaagatgaagaattattggaggcaattgttgaacgcaaaattgattactcagagaaagtttgacaatcttactaaggcagaacgtggaggactgtctgagctcgacaaagccgggttcatcaagagacaactcgttgaaacaagacagattacaaagcatgtcgcacagatattggactccaggatgaatactaagtatgacgaaaacgacaagctgatcagagaagtcaaagtgattactcttaagtctaagctcgtcagcgactttcgcaaagattttcaattttacaaagtaagggagattaataattaccaccacgctcatgacgcctacttgaatgcagtcgttggcactgcactgatcaagaagtaccccaaactcgaatctgaattcgtttatggtgattacaaagtttatgatgtccgtaagatgatagcaaagtccgagcaggaaataggaaaggctactgctaaatatttcttctactctaatattatgaatttcttcaaaactgaaataacattggccaacggggagatccgtaagcgtcctttgatagagacaaatggggaaacaggagagattgtctgggataagggaagagacttcgccaccgtcagaaaagttctctccatgccccaggtgaacattgttaaaaagaccgaggtccagacagggggtttttccaaagaatccatactgcctaagagaaactctgacaaattgatcgcaaggaagaaagattgggatccaaagaagtacggaggcttcgattcacctacagtagcttactccgtattggtagtcgctaaggtggagaaaggcaaatctaagaagctcaagtctgtaaaggaactccttggaatcacaattatggagagatccagttttgagaaaaacccaatagacttcctggaagcaaagggatacaaggaggtaaaaaaagatctgataatcaaactcccaaagtattctttgttcgagttggagaatggaagaaaacgcatgttggcttctgccggtgagctgcagaagggcaatgagcttgctctcccatccaagtatgttaatttcctgtatttggcaagccattatgaaaagttgaaaggcagccccgaggacaacgagcaaaagcagttgtttgtagagcaacataaacactacctcgacgagataattgagcaaatcagcgagttcagtaagcgtgttatcttggccgacgctaaccttgacaaagtcttgagcgcatacaacaagcatcgtgacaaacctatcagagagcaagctgagaatataatacatttgttcacacttactaatttgggcgctccagccgcttttaaatacttcgacactacaattgaccgtaaaagatacactagcacaaaagaggttctggatgcaactcttatacaccagagcattactggtttgtatgagactaggattgatcttagccaactcggaggggac

SEQ ID NO: 3 - DNA, 4104 bp, Artificial
  synthetic
atggacaagaaatactctatcgggctcgatatagggaccaactccgtcgggtgggccgtcatcaccgacgagtacaaggttccctctaagaagttcaaggttctcgggaatactgacaggcactcaatcaaaaagaacctcatcggcgccctcctctttgactccggggagaccgccgaggcaaccaggctcaagagaaccgccagaaggaggtacaccaggaggaaaaacagaatctgttacctccaagagattttctccaatgagatggctaaggtggacgacagtttcttccacaggctcgaggagtcatttctcgtggaggaagacaagaagcacgaaaggcaccccatattcggcaacatcgtcgatgaggtggcctaccatgagaagtaccccacaatttaccacctcaggaagaagctcgttgactcaacagacaaggccgatctcagattgatatacctcgcccttgcccacatgataaagtttaggggccacttcctcatcgagggggacctcaaccccgacaactccgacgttgacaagcttttcatccagcttgtccagacttacaaccagttgttcgaggagaaccccatcaacgcctctggcgtggacgccaaggccatactctccgccagactctccaagagcaggaggttggagaacctcatcgctcaactccccggggagaaaaagaacggcctttttggaaacctcatcgccctctccctcggactcacccccaattttaagagtaactttgatctcgccgaggatgcaaagcttcaactctcaaaggacacatacgacgacgatcttgacaatctcttggcccaaattggagaccagtatgccgacctctttctcgccgctaagaacctctccgacgccattctcctctccgacatcctcagggttaacaccgagatcaccaaggcccccctctccgccagcatgattaagaggtacgacgagcaccaccaagacctcacccttctcaaggcacttgtcaggcagcaactccccgagaagtacaaggagatattcttcgatcagtccaagaacgggtacgccgggtatatcgatggcggtgcctcccaagaggagttctataagtttatcaagcccatcctcgagaagatggacggaaccgaggaacttctcgtcaaattgaacagggaggacctcctcagaaagcagagaacttttgataacgggtctatcccccaccagatccaccttggcgaactccacgccattctcaggaggcaggaggacttctatcctttcctcaaagacaacagagagaagatcgagaagattcttaccttcaggataccctactacgtcgggccactcgccagggggaacagtaggttcgcctggatgaccagaaaaagcgaggagaccatcaccccctggaattttgaggaggtggtcgacaagggagccagcgcccagtcatttatcgagagaatgactaacttcgataagaatctccccaacgagaaagttttgcccaagcactccttgctttatgagtatttcactgtgtacaatgagctcaccaaggtgaaatatgtgacagaaggcatgcgcaaacccgcctttctcagcggtgagcagaagaaagccatcgtggaccttctcttcaagaccaacaggaaggtgaccgtcaagcagctcaaggaggactacttcaaaaaaatcgaatgttttgactccgtcgagatcagcggcgtcgaagacaggttcaatgcctcactcggtacttaccacgatctcctcaagatcatcaaggacaaggacttcctcgataatgaagaaaacgaggacatccttgaggacatcgtgctcaccctcaccctcttcgaggacagggaaatgatcgaggaaaggctcaagacctacgctcatctctttgacgacaaagtcatgaaacagttgaagaggaggaggtataccggttggggcagattgagcagaaaactcataaatggcatcagagataagcaatcaggcaagactatcctcgacttccttaagtcagacggattcgccaataggaactttatgcagcttatccacgatgactcactcacctttaaggaggacatccagaaggcccaggtgtccggtcaaggggacagcctccacgagcatatcgccaatctcgccgggtctcctgccatcaagaaggggatcctccagaccgtgaaggtcgtcgatgagctcgttaaggtcatgggcagacacaaacccgagaacatcgtcattgagatggccagggagaatcagaccacccagaagggccagaaaaactctagggagaggatgaaaaggatcgaggagggtatcaaggagttgggctcccagatcctcaaggagcaccccgtggaaaacacccagctccagaacgaaaagctctatctctattaccttcagaacggaagagatatgtacgtcgaccaagagttagatattaacaggctttctgattatgacgtggatcacatcgtgcctcagtccttcctcaaggacgacagcatcgataataaggtgctcaccaggtcagacaagaacaggggcaagtctgacaacgttcccagtgaagaggtcgttaaaaagatgaagaactactggaggcagttgctcaatgccaagctcatcacccaaaggaagttcgacaacctcaccaaggccgagaggggagggctcagcgagctcgacaaggccggatttatcaaaaggcagctcgttgagactagacagataaccaagcacgtcgcacagatcctcgattccagaatgaatacaaagtacgacgaaaatgacaagctcataagggaggtgaaggtgattaccctcaagagcaagttggtgtccgactttaggaaggacttccagttctacaaggtcagggagattaacaactaccaccatgcacacgacgcttacctcaacgccgtcgtgggtaccgccctcattaagaagtaccccaagcttgaatcagaatttgtctacggcgactacaaggtctacgacgtcaggaaaatgattgccaaatccgaacaggagatcgggaaagccaccgctaagtacttcttctactccaacatcatgaatttcttcaagaccgagattaccctcgccaacggggagatcaggaagaggcccctcatcgagaccaacggtgaaacaggcgagatcgtctgggacaaggggagagatttcgccactgttaggaaggtgctcagcatgccccaggtcaacatcgtgaagaagacagaggtccagactggcggattcagcaaagagtccatccttcccaagagaaacagcgacaaactcattgccaggaagaaggactgggaccctaaaaagtacggcgggttcgatagccccaccgtggcctacagcgttttggttgtggccaaagtggagaagggcaaaagcaagaagctcaagagcgtgaaggaactcctcgggatcaccatcatggaaaggtcctccttcgagaagaaccccatcgacttcctcgaagccaaggggtacaaggaggtgaaaaaggatctcatcattaaactccccaagtacagcttgttcgaactcgaaaatgggaggaagagaatgttggccagcgcaggtgaactccagaagggcaatgaactcgcccttcccagcaagtacgtgaacttcctctacctcgcttcccactatgaaaaattgaagggtagcccagaggacaacgagcagaaacagttgttcgtggaacaacacaaacactacctcgacgagatcatcgagcagatcagcgagttcagcaagagggtcatactcgccgacgccaacctcgacaaggtcctcagcgcctacaacaagcacagagacaagcccatcagggagcaggccgaaaacatcatccatctcttcaccctcaccaatcttggggcacccgccgcatttaaatacttcgacaccactattgacagaaagaggtatacatctaccaaggaggtgctcgacgccaccctcatccaccagtccataaccggcttgtacgagaccagaatcgacttgagccagctcgggggggac

SEQ ID NO: 4 - DNA, 4104 bp, Artificial
  synthetic
atggacaagaagtatagtatagggctcgacatcggcaccaatagtgttggctgggccgtgatcaccgatgagtacaaggtgccctccaaaaagtttaaggtgctcgggaataccgacagacacagcatcaaaaagaatttgatcggggccctcctctttgactccggggagaccgccgaggccaccaggctcaagaggactgccaggaggaggtacaccaggaggaaaaacaggatctgctacctccaagagatcttcagtaacgaaatggccaaggtcgacgactccttcttccacaggctcgaggagagcttccttgtggaggaagacaaaaagcacgagaggcaccccattttcgggaatattgtcgacgaggtggcctatcatgagaagtaccccaccatctaccacctcagaaagaagctcgttgacagtaccgataaagccgacctcaggctcatctatcttgccctcgcccacatgataaaatttagaggacatttcttgatcgagggtgaccttaaccctgacaactccgacgtcgataagcttttcatccagctcgtccagacatataaccagctcttcgaggagaaccccatcaatgcctctggcgttgatgccaaggccatactttcagccaggctctccaagtccaggaggctcgagaatctcatcgcccagctccctggagaaaagaagaatgggctctttgggaacctcatagccctttcattgggtctcacacccaacttcaagtcaaactttgacctcgcagaagacgccaaactccagctctccaaggacacctacgatgatgacctcgacaacctcctcgcccagattggggaccagtacgccgacctcttcctcgcagctaagaacctctctgacgccatccttcttagcgacatcttgagagtcaacaccgagatcaccaaggcccccctttcagccagcatgatcaagagatacgacgaacaccaccaggacctcacccttctcaaggccctcgtgaggcagcagctccctgagaagtacaaggagatattcttcgatcagagcaaaaacgggtatgccggatacatcgacgggggagcctctcaggaggagttctataagttcatcaagcctatcctcgaaaagatggatggcaccgaggaattgctcgtcaagctcaatagggaggacctcctcagaaaacagaggaccttcgacaacgggagcatcccccaccaaatccatctcggcgagctccacgccatacttaggagacaagaggacttctacccattcctcaaggacaacagggagaagatcgagaagatcctcaccttcagaatcccctactacgtcggaccacttgccagaggaaacagcaggttcgcctggatgactaggaaatccgaggagaccatcaccccctggaatttcgaggaagttgtcgacaagggcgcatccgcccagagctttatagagaggatgactaacttcgataaaaatctccctaacgagaaggtcctcccaaaacacagcctcctctacgagtatttcaccgtgtacaacgagcttaccaaggtcaagtacgtcaccgaggggatgaggaagcctgccttcttgagcggagagcagaagaaggccatcgttgacctcctctttaagaccaacagaaaggtgaccgtgaagcaactcaaagaggattatttcaagaaaatcgagtgtttcgacagtgttgagatcagcggcgtggaagataggttcaatgcctcactcggtacataccacgatctcctcaaaatcatcaaggacaaggacttcctcgataacgaggaaaacgaggacatcctcgaggatatcgttctcacattgaccctcttcgaggacagggagatgatcgaggagaggctcaagacctatgcccacctctttgacgataaggtgatgaagcagctcaagaggaggaggtacaccgggtggggcaggctcagcagaaagctcatcaatgggatcagggacaagcagagcgggaagaccatcctcgacttcctcaagtccgacgggtttgccaataggaactttatgcagctcatacacgacgactccctcaccttcaaggaggacatacaaaaagcccaggtcagcgggcagggcgacagcttgcacgagcacatagcaaatctcgccggttcccccgccatcaagaaagggatactccagactgtgaaggtcgtcgatgaactcgtcaaggtcatgggaaggcataagcccgagaatatcgtcatcgagatggcaagggagaaccagaccacccagaaggggcagaaaaatagtagggagaggatgaagaggatcgaggagggcataaaggagctcgggtcccagatcttgaaggagcaccctgtggagaacacacaactccagaacgaaaagctctacctctactacctccaaaacggcagggacatgtacgtggaccaagagctcgacataaacaggctctccgactacgatgttgatcacatcgttcctcagagcttcctcaaagatgacagcatcgacaataaggtccttaccagaagcgacaagaatagaggcaagagcgacaacgtgccctccgaagaggtggttaaaaagatgaaaaactattggaggcagctccttaacgctaagcttatcacccagaggaagttcgataaccttaccaaagccgaaaggggcggcttgtccgagctcgacaaggccggcttcatcaagaggcagctcgtcgaaaccaggcagatcaccaagcacgtggctcaaatcctcgatagcaggatgaatactaagtacgacgagaatgacaaactcataagggaggtcaaagttatcacactcaagagcaaactcgtgtccgacttcaggaaggacttccagttctacaaggtgagagaaatcaacaactatcaccatgcccacgacgcctacctcaatgccgtggtgggcaccgccctcatcaagaagtaccccaagctcgagagcgagttcgtttatggcgactacaaggtttacgacgtcagaaagatgatcgccaagagtgagcaagaaattggaaaggccactgccaagtacttcttctacagcaatatcatgaacttctttaagaccgagatcaccctcgcaaatggcgagatcaggaagaggcccctcatcgagaccaacggcgagaccggcgagatcgtctgggataaagggagggacttcgctactgtcaggaaagtcctcagtatgccccaagtcaacatcgtcaaaaaaaccgaagtgcaaaccggaggcttcagcaaggaatccatcctccccaagaggaatagcgacaagctcatcgccaggaagaaagactgggatcccaaaaaatacggtgggttcgactcccccactgtcgcatacagcgttctcgtggtcgccaaagtggagaaaggcaagagcaagaaacttaagagcgtcaaggaactcctcgggataaccatcatggagaggagcagcttcgagaagaatcccatcgacttcctcgaagccaagggatacaaggaggtcaaaaaggacctcatcatcaagctccccaagtatagcctctttgagttggagaacggaagaaagaggatgctcgcatcagccggggagttgcagaagggcaatgaacttgccctccccagcaagtacgtcaatttcctctacctcgccagccactacgaaaaactcaaagggtcaccagaagacaacgagcaaaagcagctcttcgtcgagcagcacaagcattacctcgacgaaatcatagagcagatctctgagttctccaaaagggttatcttggccgatgctaaccttgacaaggtgctttcagcctacaacaagcacagggataaacccataagggagcaggcagagaatattatccatctcttcaccctcaccaacctcggggcccccgcagccttcaagtacttcgataccacaatcgacaggaagaggtacaccagtaccaaggaggtgcttgatgccaccctcatacaccagtccatcaccggtctctacgagaccaggatcgatctttctcagctcgggggggac

SEQ ID NO: 5 - DNA, 4104 bp, Artificial
  synthetic
atggacaagaagtatagcatcggcctcgacatcgggaccaactcagtcgggtgggccgtgatcaccgacgagtacaaggtgccctccaagaagttcaaagtcctcggcaataccgacagacatagcatcaagaagaacctcatcggggccctcctctttgactccggggagactgctgaggccaccaggttgaagaggaccgccaggagaaggtacaccaggagaaagaacaggatctgttaccttcaggagatattttccaacgaaatggctaaagttgacgattcattcttccataggctcgaggagtcattcctcgtggaggaagacaagaagcacgagaggcaccccatcttcgggaatatcgtggatgaggttgcctaccacgagaagtatcccactatctaccacctcagaaagaaactcgtcgattccaccgacaaagccgatctcaggctcatctaccttgccttggctcacatgatcaagttcaggggccactttctcatcgagggggacttgaaccccgacaactccgacgttgataaactcttcatccagctcgtgcaaacctacaaccagctcttcgaggagaaccccatcaacgcttccggggttgacgccaaggccatccttagcgccaggctctccaagtctagaaggctcgagaacctcatcgcccagttgcccggggagaaaaagaatgggttgttcggcaacctcatagccttgagtttgggactcacacccaacttcaagagcaacttcgacctcgccgaagatgccaagttgcagctctctaaggacacctacgacgacgacctcgacaaccttctcgcccagataggcgaccagtacgccgacctcttcctcgccgccaagaacctctctgacgccatcctcctcagcgacatcctcagggtcaacaccgagatcaccaaggcccctctttccgccagcatgatcaagaggtacgacgagcaccatcaggacctcaccctcctcaaagccctcgtcagacaacagctccccgagaaatacaaggagattttcttcgaccaatccaagaacggatatgccggctatatagacgggggggcttcccaggaggagttctacaagtttatcaagcccatcctcgagaagatggacggcaccgaggagctcctcgttaagctcaatagggaggacctcctcaggaaacagaggacattcgacaacggctcaatcccccatcagatacatctcggggagctccatgccatcttgagaaggcaggaggacttctaccccttcctcaaggacaatagggaaaagatcgagaagatcctcaccttcaggatcccttactacgtcggccccctcgccagggggaatagcaggttcgcctggatgaccaggaagagcgaggagaccatcaccccttggaacttcgaagaggtggtggacaaaggcgctagcgcccagagcttcatcgagaggatgaccaactttgataagaacctccctaacgaaaaagtcttgcccaagcactccctcctctacgagtactttaccgtttacaacgagctcaccaaggtcaaatacgtcaccgaaggcatgaggaagcccgccttcctttccggcgagcagaagaaggccattgttgaccttttgttcaagaccaacaggaaagtgaccgtcaagcagctcaaagaggattacttcaagaaaatcgaatgcttcgacagcgtcgaaatctccggcgtggaagacaggttcaacgcaagcttgggcacctaccatgaccttctcaagattatcaaggataaggactttctcgacaacgaggaaaacgaggatattctcgaggatatagtgctcacactcaccctcttcgaggacagggagatgattgaggaaaggctcaagacctacgcacacctcttcgacgacaaggttatgaaacagctcaaaaggaggaggtacaccggctggggtaggctttccaggaagctcatcaacggaatcagggacaaacagagcggaaagaccattctcgacttcctcaagagcgacggctttgccaacaggaattttatgcagctcatccacgacgactcactcaccttcaaggaagatatccaaaaagcccaggtctccggacagggtgacagccttcacgagcacatcgccaacttggccgggtctcccgccatcaagaagggcattcttcagactgtcaaggtggtggacgagctcgtgaaggttatgggcagacacaagcccgagaacatcgttattgagatggccagggagaatcagaccacccagaaaggccagaaaaatagcagggagagaatgaagaggattgaagaagggatcaaagagctcggctcccagatcctcaaagagcatcccgtggagaatactcagcttcaaaacgagaagctctacctctactacctccagaacggcagagatatgtacgtcgaccaagaactcgacatcaacaggctctccgactacgacgtggaccacatcgtcccacagtccttcctcaaggacgactccatagacaacaaggtcctcaccaggagcgacaagaacagggggaaatctgataatgtgcccagcgaggaggtcgtgaagaagatgaagaactactggaggcaattgttgaacgccaaactcatcacccaaaggaagttcgacaatctcaccaaggccgagagggggggcctcagcgagcttgacaaggccggcttcataaagaggcagctcgtcgagaccaggcagatcacaaagcacgtcgctcaaatcctcgacagcagaatgaacaccaagtacgacgagaacgacaagcttatcagagaggtgaaggtcatcactttgaagagcaagctcgtttctgacttcaggaaggatttccaattctacaaggttagagagatcaacaactaccaccatgcccacgacgcttacctcaacgccgtcgttggaaccgccctcatcaagaagtatcctaaactcgagtccgagtttgtgtatggagactataaggtctacgacgtcagaaagatgatcgccaagtccgagcaggagatcggaaaggccaccgcaaagtactttttctactccaacataatgaacttcttcaaaactgagatcactctcgccaacggggagatcaggaagaggccactcatcgagaccaacggtgagaccggcgagatcgtctgggacaaagggagggatttcgccactgtcaggaaggttctcagcatgccacaggtcaacatagtcaagaagaccgaggttcagactgggggcttctccaaagagagtatccttcccaagaggaacagcgacaaactcatcgcaaggaagaaagactgggaccccaagaagtacggcggcttcgacagccccaccgtcgcctattccgtcctcgttgttgccaaggttgagaagggtaaatccaagaagctcaaatccgttaaggaactcctcgggataaccatcatggagaggagctccttcgagaaaaaccccattgactttctcgaggccaaggggtataaagaagtcaaaaaggacctcatcatcaagctcccaaaatacagcctcttcgagcttgaaaacggtaggaagaggatgcttgcctccgccggggagctccagaaggggaacgagctcgccctcccctctaagtacgtgaacttcctttatttggcttcccactacgagaagctcaaaggcagccccgaggacaatgagcaaaagcagctctttgtcgagcaacacaagcactacctcgatgagatcattgagcagatctccgagttctccaaaagggtcattctcgccgacgcaaaccttgacaaggtgctctcagcctataacaagcacagggacaaacccatcagagagcaggctgagaatatcatccacctcttcaccctcaccaatttgggcgcccccgccgcctttaagtacttcgacactaccatcgacaggaagaggtacacaagcaccaaagaggtgctcgacgccaccctcatacatcagtcaattaccgggctttacgaaactaggatcgacctcagccaacttgggggagat

SEQ ID NO: 6 - DNA, 4104 bp, Artificial
  synthetic
atggacaagaagtactctatcgggctcgatatcggtaccaacagcgtcggttgggccgttatcaccgacgaatataaggtgcccagtaagaagttcaaggtcctcggtaacacagacagacattccatcaagaagaatctcatcggtgccctcctctttgacagcggtgagacagccgaggccacaaggctcaagaggaccgccaggaggaggtacaccaggagaaagaacagaatctgctacctccaggagatcttcagcaacgaaatggccaaggtggatgattccttcttccacagattggaggagagctttctcgtggaggaggataagaagcacgagaggcatcctattttcggcaacatcgttgacgaggtcgcctatcatgagaaatatcccaccatttaccacctcaggaaaaagctcgtggacagcactgataaggccgacttgagattgatctacctcgcccttgcccacatgatcaagttcagagggcacttcctcatcgagggagacctcaacccagacaacagcgacgtcgacaagctcttcatccagctcgtgcagacttacaaccagctcttcgaggagaaccccatcaacgccagtggcgtggacgccaaggccatcctcagcgctaggctcagcaaatctaggaggttggagaacttgatcgcccagctccccggcgagaagaagaatgggcttttcgggaacctcattgccctctccctcggcctcacccccaacttcaagtccaacttcgacctcgccgaggatgccaagctccaactcagcaaggacacctacgatgacgatctcgacaacctcctcgcccaaatcggggaccagtacgcagatctctttctcgctgccaagaacctctccgacgccatcctcttgagcgacatcctcagagtgaacaccgagatcactaaggcccccctctctgccagcatgatcaagaggtacgacgagcatcaccaggacctcactcttctcaaggccctcgttaggcagcagctccccgagaagtataaggagatcttctttgaccagagcaagaacgggtacgccggatacattgacggaggggcctcccaggaagaattttacaagttcatcaagcccatcctcgagaaaatggacgggaccgaagaactcctcgtgaagctcaacagagaggacctcttgaggaagcaaaggaccttcgataacggcagcatcccccatcagatccacctcggtgagctccacgccatactcaggaggcaggaggacttttacccatttctcaaggacaacagggaaaaaatcgagaagatcctcaccttcaggatcccctactacgttggccccctcgccagagggaactccaggttcgcctggatgaccagaaagagtgaagagaccatcaccccctggaacttcgaggaggttgtggacaagggggccagcgcccagagtttcatcgagaggatgaccaactttgacaagaacctccccaatgagaaagtcctccccaagcacagcctcctttacgagtacttcaccgtctacaatgagctcaccaaggttaaatacgtcaccgaaggcatgagaaaacccgccttcctctccggcgagcagaagaaggcaatagtggatctcctctttaaaacaaacaggaaggtgaccgtcaaacagctcaaggaagactacttcaagaagatagagtgcttcgatagcgttgaaatctccggcgtcgaggacaggtttaatgccagcctcgggacttaccacgacctcctcaagatcatcaaggacaaggatttcctcgacaacgaggagaatgaagatatcctcgaggacatcgtcctcacccttaccctcttcgaggatagagagatgatcgaggagaggctcaagacttacgcccacttgttcgacgataaagtcatgaagcaactcaaaaggagaaggtacaccggatgggggaggctcagcaggaagttaatcaatggtatcagggacaagcaaagcggtaaaactatcctcgatttcctcaaatccgacggctttgccaacaggaacttcatgcagctcatccacgacgacagccttaccttcaaagaggacatccagaaggctcaagtctctggccagggagacagcctccacgagcacatagccaacctcgccgggtctcccgccatcaagaagggaatccttcagaccgtcaaggtcgttgatgagctcgtaaaagtgatgggcaggcacaagccagagaacatcgtcatagagatggccagggagaaccagaccacccagaaaggccagaaaaacagcagagaaagaatgaagaggatcgaagaagggataaaggagctcgggtcccagatactcaaagagcacccagttgagaatacccagctccaaaacgagaaactctacctctactacctccagaatgggagggacatgtatgtggaccaagagcttgacatcaataggttgtccgactacgacgtcgaccacatcgtcccccagagctttctcaaggacgacagtatcgacaacaaggtgctcaccaggtccgacaagaacagagggaagagcgacaacgtcccctccgaggaagtggtgaaaaagatgaagaactactggaggcaattgttgaacgccaagctcatcacccagaggaagttcgataacctcaccaaggcagagagggggggtctctctgagctcgacaaggccggtttcatcaaaaggcagcttgtggagacaaggcaaatcaccaagcatgtcgctcagatcctcgactccaggatgaacaccaagtacgatgaaaatgacaagctcatcagggaggttaaggtcatcaccttgaagtctaaactcgttagcgacttcagaaaggatttccagttctacaaggtgagggagatcaacaattaccatcacgcacacgacgcctatctcaacgctgttgtcggcacagccctcattaagaagtaccccaagctcgagagcgagttcgtctatggtgattataaggtttacgacgtcaggaagatgatcgccaagagcgagcaggagatcggaaaggcaaccgccaagtacttcttctactccaacatcatgaacttcttcaagaccgagataaccctcgccaacggcgagatcaggaaaaggcccctcatagaaaccaatggggaaacaggagagatcgtttgggacaagggtagggacttcgcaaccgtgaggaaggttcttagcatgccccaggttaatatcgttaagaagacagaggtgcagaccggagggttctctaaagagagcatcctcccaaaaagaaacagcgataagctcatagccaggaaaaaggactgggaccccaaaaagtacgggggttttgacagtcccaccgttgcctattcagttctcgtggtcgctaaggtcgagaagggcaagagcaagaagttgaagagtgttaaggaactcctcggcatcaccatcatggagaggagctccttcgaaaagaaccccatcgacttcctcgaagccaagggttacaaggaggttaagaaggatctcatcatcaagctccctaagtacagcctctttgagctcgaaaatgggaggaagaggatgcttgctagcgccggagagttgcagaaagggaacgagctcgccctcccctccaagtacgttaacttcctctacctcgcctcacactatgagaagcttaaaggatcacccgaggacaatgagcaaaagcagctctttgtggagcagcacaagcactatctcgacgagatcatagagcagatttccgagttctcaaaaagggttattctcgccgatgccaacctcgataaggtcctctccgcctataacaagcacagggacaagcccataagagagcaggccgaaaacattatacatctttttacccttaccaacctcggggcccccgccgccttcaagtacttcgataccacaatcgataggaagagatatacctccactaaggaagttctcgacgccacattgatccaccagagcataacaggcctctacgagaccaggatcgatttgtcccagctcggcggtgat

SEQ ID NO: 7 - DNA, 4104 bp, Artificial
  synthetic
atggacaagaagtactccatcggactcgacattgggaccaactccgtgggctgggccgttatcaccgacgaatacaaggtcccctcaaagaaattcaaggttctcggaaatactgataggcactccatcaagaagaacctcataggggctctcctcttcgactctggggaaaccgccgaggctaccaggctcaagaggaccgccaggaggaggtacaccaggagaaagaatagaatctgctatctccaggagatattctcaaacgaaatggccaaagtcgacgactctttcttccacaggcttgaggaaagcttcctcgttgaggaggacaagaagcacgagagacaccctatcttcggtaacatcgttgacgaagtggcataccacgagaagtaccccaccatctaccatctcaggaagaagctcgttgatagcaccgacaaggccgacctcagactcatttatttggcactcgcacacatgatcaaattcagggggcacttcctcatcgaaggggacctcaatcccgacaatagtgatgtggacaagctcttcatccagctcgtccagacttataaccagctcttcgaagagaatcccattaacgccagcggagtggacgctaaagccatcctcagcgccaggctctccaagtccaggaggcttgagaatctcatcgcccagttgcctggcgaaaagaaaaacgggctcttcggtaacctcatcgcactctccctcggccttacccccaactttaagtccaactttgacctcgccgaggacgctaagctccaactcagcaaagacacctacgatgatgacctcgacaacttgctcgcccagatcggcgaccagtacgctgatttgttcttggccgccaagaatctcagcgacgcaattctcctctccgacatcttgagggtcaataccgagatcaccaaagcccccctcagcgccagcatgatcaaaagatatgacgaacaccaccaagacctcacacttctcaaggccctcgttaggcaacagctccccgagaagtacaaggaaatcttcttcgaccagagcaagaatgggtacgcagggtacatcgacgggggcgcctctcaagaggagttctacaagtttattaagcccatcttggagaaaatggatgggaccgaagagcttctcgtgaaactcaacagggaggaccttctcaggaagcaaagaaccttcgacaatggcagtataccccatcaaatccatctcggagagctccacgccatcctcaggaggcaggaggacttctatcccttccttaaggacaacagagaaaaaatcgagaagatcttgaccttcaggatcccctactacgtcggccccctcgccagggggaactccagattcgcttggatgaccaggaagagcgaggagacaatcactccatggaacttcgaagaagtggttgacaaaggggcatccgcccagtccttcatagagaggatgaccaactttgacaagaatctccccaacgagaaggtcctccccaagcactccctcctctatgagtacttcactgtttataacgaactcaccaaggttaagtacgtcaccgagggaatgagaaagcccgccttcctctccggcgagcaaaagaaggccatcgtggacctcctcttcaaaaccaataggaaggttaccgttaagcagctcaaggaggattacttcaagaaaattgagtgctttgatagcgtggagatcagcggggttgaggacaggttcaacgcatcacttggtacataccacgatttgctcaagataatcaaggataaggactttctcgacaacgaggagaacgaggacattctcgaagacatcgtgctcaccttgaccttgttcgaagatagggagatgatcgaggaaaggctcaaaacctacgctcatctcttcgatgacaaggttatgaaacagctcaaaaggaggaggtacactggttggggcaggttgagcaggaaactcatcaacggaatcagggacaagcaaagcggtaagacaatcttggatttccttaagtccgatgggtttgctaacaggaacttcatgcagctcatccacgatgatagcctcacattcaaggaggacatccagaaggcccaggtcagcgggcagggggacagcctccatgagcacatcgccaacctcgccggcagtcccgcaattaagaaagggatcctccaaaccgtcaaggttgtggacgaactcgtgaaggtcatgggaaggcacaagcccgagaacatagttatcgagatggccagggagaatcagacaacccaaaaggggcagaagaactccagggagaggatgaaaaggattgaggagggaatcaaggagctcgggtcccagatcctcaaagagcacccagtggagaacacccagctccaaaacgagaagctttatctctactatcttcaaaacgggagggacatgtacgtcgaccaggagctcgacatcaacagactcagcgactacgacgttgaccatatcgttcctcagtcatttttgaaggacgactccatcgacaacaaggtgctcaccagaagcgacaagaataggggcaagtctgacaatgtgccctcagaggaggtcgtcaagaagatgaagaactactggaggcagctcctcaacgctaagctcatcacacagaggaaattcgacaacctcaccaaggccgaaaggggggggctctccgagctcgacaaggccggcttcatcaagaggcagctcgttgagaccaggcagatcaccaaacatgtcgcccagatcctcgacagtagaatgaacacaaagtacgacgagaacgacaagctcatcagagaggtcaaggttatcaccctcaaatccaagctcgtgtctgacttcaggaaagacttccagttctacaaggtgagggagatcaacaattatcaccacgcccatgatgcctacctcaacgccgtcgttgggaccgccctcatcaagaagtatcccaaactcgagagcgaattcgtctacggcgactataaggtctacgacgtgaggaaaatgatcgccaaatccgagcaggaaatcggtaaggccaccgccaagtacttcttctactccaacatcatgaacttcttcaagaccgagatcaccctcgccaacggtgagatcaggaagaggcccctcatcgaaaccaatggagagacaggcgaaatcgtgtgggataagggcagggactttgccaccgttaggaaggttctctcaatgccccaagtcaacatcgtcaagaagactgaggtccagacagggggcttcagcaaggaaagcatccttcccaagaggaactccgacaagctcatcgcaaggaagaaggactgggacccaaagaagtacgggggcttcgactcccccaccgttgcctattccgtgctcgtggttgcgaaggttgagaaggggaagtccaagaagctcaaaagcgtgaaggaactcctcggcatcactatcatggagagatctagcttcgagaagaatcccatcgatttccttgaagctaaggggtacaaggaagtcaagaaggaccttatcattaagctcccaaagtactctctcttcgagctcgaaaatggcaggaagaggatgctcgcctccgccggggagctccaaaaggggaacgaactcgccctccccagtaaatatgtcaacttcctctatctcgcctcccactatgaaaagctcaaggggagccccgaagacaacgaacagaagcaactcttcgtggaacagcataagcattacttggacgagatcatcgagcagatctccgagttttccaagagagtgatcctcgccgatgccaaccttgacaaggttctctcagcctataacaagcatagggacaaacccatcagggaacaggccgagaatatcatccatctcttcaccctcaccaacctcggcgccccagccgcatttaagtactttgacaccactatcgacaggaaaaggtataccagcaccaaagaggtcctcgatgctaccctcatccaccaatccatcaccggcctctacgagaccaggatcgacctctcccaactcgggggcgac

SEQ ID NO: 8 - DNA, 4104 bp, Artificial
  synthetic
atggacaagaaatactcaatcggtctcgatatcggcaccaatagcgtgggctgggccgttatcaccgacgagtacaaggtcccaagcaagaagttcaaggttctcgggaacaccgacaggcacagcataaagaagaacctcataggggccctcctcttcgacagcggcgagaccgccgaagccaccaggctcaagaggaccgccaggaggaggtacactaggagaaagaacaggatctgctacctccaagaaattttttccaacgaaatggccaaggtcgacgactccttcttccataggctcgaggaatccttccttgttgaggaagacaagaagcatgagaggcatcccatattcgggaacattgtcgatgaggttgcctaccacgagaaatatccaactatctaccacctcagaaagaaactcgtggacagcaccgacaaggccgatcttaggcttatctacctcgccctcgcccacatgataaagttcaggggccacttcttgatcgagggcgacctcaaccccgacaatagcgacgtcgataagctcttcatccaactcgtccagacctacaaccagctcttcgaggagaatccaatcaacgcctccggggtggacgccaaagccatactcagcgcccgtctctcaaaatccagaaggctcgagaaccttattgcccaactccccggtgagaagaagaacggcctctttggaaacctcatcgctctcagcttgggccttactcccaactttaagagcaacttcgacctcgccgaggatgccaaactccaactcagcaaggacacctacgacgacgacctcgacaacttgctcgcccagattggggatcagtacgccgaccttttcctcgccgccaaaaaccttagtgacgccatcctcctctccgacattcttagggtgaataccgagatcaccaaggcacccctcagcgcctcaatgatcaagagatacgacgagcaccatcaggatctcactctcctcaaagccctcgtgaggcaacagctcccagaaaagtacaaggagatttttttcgaccagagtaagaacgggtacgccgggtacatcgacggcggcgcttcccaggaagaattctacaagttcataaagcccatcctcgagaagatggacggcactgaggaattgctcgtgaagctcaacagggaagatctccttaggaagcagaggacctttgacaacgggagcatcccccaccagatccacctcggcgagctccacgcaatccttaggagacaggaggacttctaccccttccttaaggacaacagggagaaaatcgagaaaatacttaccttcaggatcccctactacgtcggcccacttgccagggggaacagcaggttcgcctggatgaccaggaagtcagaggagactatcaccccctggaatttcgaggaggtggtcgataagggcgcctcagcccagtcctttattgaaaggatgacaaatttcgataagaacttgcccaacgagaaggtcctccccaaacactccctcctctacgagtatttcactgtctacaatgagttgacaaaggtgaaatacgttaccgagggcatgaggaagcctgcattcctcagcggtgaacagaagaaggctatcgttgatcttttgtttaagactaatagaaaagttactgttaagcagctcaaagaggactatttcaaaaagatcgaatgcttcgactccgtggagatcagcggggtcgaagacaggtttaacgcctccctcgggacctaccatgacctcctcaagatcatcaaagacaaggatttcctcgacaacgaggagaacgaggacatcttggaggatatcgtgctcaccctcaccctcttcgaggacagggagatgatcgaggagaggctcaagacatacgcccacctcttcgacgacaaggtcatgaagcaactcaaaagaaggaggtacaccgggtggggtagactcagcaggaagctcatcaatggcatcagagataagcagagtggtaagactatcctcgatttcctcaagagcgacggcttcgccaataggaacttcatgcaattgatacacgacgatagcctcaccttcaaagaggacatccagaaagcccaggtttccggtcaaggggacagcctccacgagcacatcgccaaccttgccggcagtcccgcaattaaaaagggcatcctccagaccgttaaagtcgttgacgagcttgtcaaggtgatgggcagacacaagccagaaaacatcgtcatcgagatggccagggagaaccagaccacccagaagggccaaaagaactccagagagaggatgaaaaggattgaggagggtatcaaggagcttggatcccagatcctcaaagagcatccagtcgagaacacacagctccagaacgagaaactctacctctattacctccagaacggaagggacatgtacgtcgatcaggagctcgatatcaacaggctcagcgactacgacgtcgaccatatcgtcccccagtcctttctcaaggacgacagcattgacaacaaggtgctcaccagatccgacaagaacagaggcaagtcagataacgttccctccgaggaggtggttaaaaagatgaagaactattggaggcagctcctcaatgcaaagctcatcacccagaggaagtttgacaacctcaccaaggcagaaagggggggcctctccgagctcgacaaggccggattcatcaagaggcagcttgtcgaaaccaggcagatcacaaaacatgtggcccaaatcttggattccaggatgaacacaaagtatgacgagaacgataaattgatcagggaggtgaaggtgatcacccttaagagcaagctcgtcagtgacttcaggaaggacttccagttctacaaagtcagagagatcaacaactatcaccatgcccacgatgcttatcttaacgcagtggttggcaccgctcttatcaagaaataccccaagctcgagtccgaattcgtgtacggcgactacaaggtttacgacgttaggaagatgatcgccaaatccgagcaagagatcgggaaggccaccgccaaatacttcttttactccaacataatgaacttcttcaagaccgagatcactctcgccaacggggagatcaggaagagacccctcatcgagaccaacggagaaaccggggagatcgtgtgggataagggcagggactttgccaccgtgagaaaagtcctcagcatgccccaggtgaacatagtcaagaagaccgaggtgcagaccgggggattcagcaaggagagcatcttgcccaagaggaactccgataaactcatcgccaggaaaaaggactgggaccccaaaaagtacgggggtttcgactcccccaccgtcgcctactccgtcctcgttgtggcaaaggttgagaaggggaagagcaagaagcttaagagtgtcaaagaactcttggggatcaccatcatggagaggagctcctttgagaagaaccccatcgacttcctcgaggccaagggctacaaggaggtgaagaaggatctcatcatcaaacttccaaagtactccctctttgagctcgagaacggaagaaaaaggatgctcgccagcgccggggagctccagaaaggtaatgagctcgccctcccaagcaagtacgttaacttcctctatctcgcaagccactatgagaagctcaaagggagtcctgaagataatgagcaaaaacagctcttcgtcgagcagcacaagcactacctcgacgagataatcgagcagatctccgagttctccaagagggtcatcctcgccgacgctaacctcgacaaggttctctccgcctacaataaacacagggataagcccatcagggagcaagccgaaaacattatacatctcttcacccttacaaatctcggggcccccgccgcttttaagtatttcgacacaaccatcgacaggaaaagatacacatccactaaagaagttctcgatgccaccctcatacaccagagcatcaccgggctctatgaaacaaggattgacctctcccagctcggcggcgac

SEQ ID NO: 9 - DNA, 4104 bp, Artificial
  synthetic
atggacaaaaaatatagtatcggattggacatcgggactaactccgtggggtgggctgttataaccgacgagtacaaggtgcccagtaagaagttcaaagtcctcggcaataccgacagacacagcattaagaagaacctcatcggcgctctccttttcgattccggcgagaccgccgaagccaccaggctcaagaggacagcaaggaggagatataccagaaggaagaacaggatctgctacttgcaggagatctttagcaacgagatggccaaggtggacgacagcttcttccacaggctcgaggagagctttctcgtggaggaggataagaagcacgagaggcaccccatctttgggaacatcgtggacgaagtcgcttaccatgagaagtaccccaccatttatcacctcaggaagaagctcgtcgacagcaccgacaaagcagaccttaggctcatctacctcgccctcgcccacatgataaagttcaggggccactttcttatcgagggcgacttgaaccccgacaatagtgacgttgacaagctcttcatccagctcgttcaaacctacaaccagctcttcgaggagaaccccatcaatgcctctggtgttgacgccaaggcaatcctcagcgccagactcagcaagtccaggaggctcgagaacctcatagcacaactccccggcgaaaagaaaaatggcctcttcgggaacctcatcgccttgagcctcggactcacccccaacttcaagagcaacttcgacctcgccgaggacgcaaagcttcaactcagtaaggacacctatgacgacgacctcgacaacctcctcgcccagatcggggaccagtacgccgacctcttcctcgccgccaaaaacctctccgacgctatcttgttgagtgacatcctcagggttaacaccgagatcactaaggcccccctcagtgccagcatgataaagaggtatgacgagcaccatcaggatcttaccctccttaaagctctcgttcgtcaacaactccccgagaagtataaggaaatcttcttcgaccagtcaaagaacggctatgccgggtatatcgacgggggggcaagccaggaagagttttacaaattcataaagcccatcctcgaaaagatggacgggaccgaggaactcctcgtcaagctcaatagggaggacctcctcaggaagcaaaggacctttgataacgggagcatcccccaccaaatccacctcggcgagctccacgccatccttaggaggcaggaggacttttaccccttcctcaaagacaacagggagaagatagagaagatactcaccttcaggatcccctactatgtcgggcccctcgccagagggaattccaggttcgcttggatgaccaggaaatctgaagaaaccataacaccctggaactttgaagaggtggtcgacaagggggcttccgcccagtccttcatcgagaggatgaccaacttcgacaagaatctccctaatgagaaggtcctccccaagcattcccttctctatgaatactttaccgtgtacaacgagctcaccaaggtgaagtacgtcaccgagggcatgaggaagcccgcatttcttagcggcgagcagaagaaggcaatagtggatctcctcttcaagaccaataggaaggtgaccgttaagcagctcaaggaggattactttaagaaaatcgagtgcttcgattcagtcgaaatcagcggggtggaggacaggttcaatgcaagtctcggtacctatcacgacctcctcaagatcattaaggacaaggactttctcgacaacgaggagaacgaggacatcttggaggatatcgtgctcaccctcacactctttgaggacagggagatgatcgaagagaggctcaagacctacgcccatctctttgacgacaaagtgatgaaacaactcaagaggaggaggtacaccggctggggcaggctctccaggaaactcataaacgggatcagagataaacaaagcggaaagacaatcctcgatttcctcaaatccgatggtttcgccaacaggaacttcatgcagctcatccatgacgactcactcaccttcaaagaggatatccaaaaggcccaggtcagcggccagggggactccctccatgagcacatagccaatctcgccggctccccagccatcaagaagggcatcctccagaccgtcaaagttgtggacgagttggtcaaagtcatgggcagacacaaacccgaaaacatcgtcatcgaaatggccagggagaatcaaaccacacagaagggtcaaaagaacagcagggagaggatgaagagaattgaagaaggaatcaaagagctcggaagccagatcctcaaggagcacccagtcgagaacacccagctccaaaacgagaagctctacctctactacctccagaacggcagggacatgtacgtcgaccaggaactcgacatcaacaggctctctgactatgacgtggaccacattgtgccccagtccttcctcaaggacgacagcatcgacaataaggtcctcactaggagcgacaaaaacagaggtaagtccgataatgtgccctccgaggaagtggtgaagaagatgaagaattactggaggcagcttttgaacgccaagttgataacccaaagaaagttcgacaacctcactaaggctgagaggggtggactctcagagttggacaaggccggattcatcaagaggcagctcgtggagaccaggcagataaccaagcacgtcgctcaaatcctcgactccaggatgaacaccaagtacgacgagaatgacaagctcatcagggaagtgaaagttatcacccttaaaagcaaactcgtgtccgacttcaggaaagacttccagttctataaggttagagagattaacaactaccatcacgcccacgacgcctatttgaacgccgttgtgggaaccgcccttattaagaaataccccaagctcgaaagtgagttcgtgtacggcgactacaaagtttatgacgtcagaaaaatgattgccaagagcgagcaagagatcgggaaggctaccgccaagtactttttctacagcaacatcatgaacttcttcaagaccgagatcaccctcgcaaacggcgagatcaggaagaggcccctcatcgagaccaacggcgagaccggggagatcgtctgggacaaaggtagggactttgccaccgtgagaaaggtcctctccatgccccaggtcaacatcgtcaagaagaccgaagttcagaccggggggttttcaaaggaatctatcctccccaaaagaaacagcgacaagctcatcgccagaaagaaggactgggaccccaagaagtacggcggctttgactcccccaccgtcgcctacagcgttctcgtggtcgccaaggttgaaaaggggaaaagcaaaaaactcaagtccgtgaaggagcttctcggtattactatcatggagaggtcttcattcgagaagaatcccatcgatttcctcgaggcaaagggttacaaagaggtcaaaaaggatctcattatcaagcttcctaaatactcattgttcgaactcgagaatggcaggaagagaatgcttgcctccgccggcgagttgcagaagggcaacgaactcgcactccccagcaagtacgtcaacttcctctacctcgccagccattacgaaaaacttaaaggctcccccgaggacaacgagcagaagcagcttttcgttgagcagcacaaacattacctcgacgagatcatcgagcagatctccgagttcagcaagagggttatcctcgctgacgccaacctcgacaaggtcctttccgcctacaacaagcacagagataagcccatcagggagcaggccgagaacatcatccacctcttcacccttacaaacctcggcgcccctgccgcctttaaatacttcgacacaacaatcgacaggaagagatacaccagcactaaggaagtgctcgacgccactctcatccaccaatcaatcaccgggctctacgagaccagaatcgacctcagccagttgggtggcgac

SEQ ID NO: 10 - DNA, 4104 bp, Artificial
  synthetic
atggacaagaaatacagcattggtctcgacatcggtaccaactccgtgggctgggcagtcatcaccgacgagtataaggtgcccagcaaaaagttcaaggtgttggggaacactgacaggcactccatcaaaaagaacctcattggcgcactcctttttgacagcggtgagaccgcagaagccaccaggttgaagaggaccgccagaaggagatacacaaggagaaagaacagaatctgctatctccaggaaatcttctccaatgagatggccaaagtcgacgattccttcttccacaggctcgaggagtcattcctcgttgaggaggacaagaagcacgagaggcaccccatcttcgggaacatagtggatgaagtggcctaccacgagaagtaccccaccatctaccacctcaggaagaagctcgttgacagcaccgacaaagccgacctcaggctcatctaccttgccctcgcccacatgatcaaatttaggggtcatttcctcattgagggcgacctcaaccccgacaacagcgatgtggacaagctcttcatccagcttgtgcagacctacaaccagctcttcgaggagaaccccataaacgcctcaggcgttgacgcaaaggccattctctctgccagattgtccaagtccagaaggctcgagaacctcatcgcccagctccccggagagaagaagaacgggctcttcggaaatctcatcgccctctccctcggactcacacccaacttcaaatccaactttgacctcgccgaggatgcaaagctccaactctccaaggacacctacgacgacgacctcgacaacctcctcgcccaaatcggggaccagtacgccgacctcttccttgctgccaaaaacctcagcgacgccatcctcctcagcgatatactcagagtcaataccgaaatcacaaaggcccccctctccgcctccatgatcaagaggtacgacgaacaccaccaggatctcacattgctcaaggccttggtcagacagcagctccccgagaaatacaaagaaatcttcttcgaccagtccaagaacggctacgccggttacatcgacggaggtgcctcccaagaggagttctataagttcatcaagcccatcttggagaaaatggacgggaccgaggagctcctcgtgaagcttaatagggaggatctcttgagaaagcagaggacattcgataacggcagcatcccccaccagatccacctcggagagctccacgccatcttgaggagacaggaagatttctatccctttctcaaagataacagggagaaaatcgagaagatcctcaccttcagaattccctactacgttggacccctcgccagaggcaattcaaggttcgcctggatgacaaggaagagcgaggagaccatcaccccatggaactttgaagaagtcgtcgataaaggggccagcgctcaaagcttcatcgagaggatgaccaacttcgacaagaacttgcccaacgagaaggtcctccccaagcactcccttctctacgaatacttcactgtctataacgaactcactaaagtcaagtacgttaccgagggcatgaggaaacccgccttcctttccggggagcagaagaaggccatagttgacctccttttcaagaccaacaggaaggtgaccgttaaacagctcaaagaggactacttcaagaagatagagtgcttcgactctgtggagatttccggggttgaggataggttcaacgccagtctcgggacctaccatgacctcctcaagatcatcaaggacaaggacttcctcgacaacgaggagaacgaagacatcttggaggatatcgtcctcacccttaccctcttcgaggacagggagatgatcgaagagagactcaagacttacgcacacttgttcgacgacaaagtcatgaaacaactcaaaaggagaaggtacaccgggtggggcaggctctctaggaagttgatcaacggtattagagacaaacagagcgggaagaccatccttgacttccttaaaagtgacgggtttgccaataggaacttcatgcagctcatccacgacgacagcctcaccttcaaggaagacatccagaaggctcaagtgtccggccagggggattcactccatgaacatatcgccaacctcgccggcagccccgctatcaagaaagggatactccagaccgtcaaggtcgttgacgagctcgtgaaagttatgggcagacacaagccagagaacatcgtgatcgagatggccagggaaaaccagacaacccagaaaggtcagaagaactccagggagaggatgaaaaggatcgaggagggcatcaaagagcttgggtcccaaatactcaaagagcaccccgtcgagaacacccaactccaaaacgagaagctctacctctattaccttcagaatggcagggacatgtacgtggaccaagagttggatatcaacaggctcagcgactacgacgtggaccacatcgtgccacagagcttccttaaggacgactccatcgataacaaggttctcactagaagcgacaagaacagaggcaagagtgacaatgtcccttcggaagaggtcgttaagaagatgaagaactactggaggcagctcctcaacgcaaagcttatcacccaaaggaagttcgataatctcaccaaagccgagagaggggggttgagcgaactcgacaaggccggcttcataaaaagacagctcgtcgagactaggcaaatcaccaaacacgttgcacaaatcctcgatagtaggatgaataccaaatatgacgagaacgataagctcatcagagaggtgaaggtgatcaccctcaagagcaaactcgtgtccgatttcaggaaggacttccagttctacaaagtgagagagataaacaactatcaccatgcacatgacgcttaccttaacgccgttgttggcaccgccctcatcaaaaagtaccctaagttggaatccgaatttgtttacggggactacaaggtttatgacgtcaggaagatgatcgcaaaatctgagcaggagattggcaaggccaccgcaaagtactttttctactccaatatcatgaatttcttcaaaacagagattaccctcgccaacggggagattagaaagagacccctcatcgaaaccaacggggagaccggggagatcgtctgggacaaggggagagacttcgccaccgttaggaaagtgctctctatgccccaagtgaacatcgtgaagaagacagaggttcagactgggggctttagcaaggagagcatcctcccaaagaggaacagcgacaagttgatcgccagaaagaaagactgggatcccaagaagtacggcgggttcgacagcccaaccgtcgcctacagcgtcctcgtcgtcgcaaaagtggagaagggcaaatccaagaagctcaagtccgtgaaagagcttctcgggatcaccataatggaaaggagctccttcgagaagaaccccatcgacttccttgaggccaagggctacaaagaggtgaagaaagacttgatcatcaagctccccaagtactccctcttcgagctcgagaatggcaggaagaggatgctcgcctcagccggcgagctccaaaagggcaacgagcttgcccttcccagcaagtacgttaactttctctacctcgccagccactacgagaagctcaaggggtcccccgaggacaacgagcaaaagcagctcttcgtggaacagcacaagcactatctcgatgagatcattgagcagatcagtgagtttagcaagagggtcatccttgcagacgccaacttggacaaggtgctctccgcctataacaagcacagagacaagcctatcagggagcaggccgagaacatcatccatctcttcaccttgaccaacttgggcgccccagccgccttcaagtactttgacaccaccatcgacaggaagaggtacacatccaccaaagaggttctcgacgccacactcatccaccagtccataaccgggctctacgagaccaggatcgatctctcccaactcgggggggac

SEQ ID NO: 11 - DNA, 4104 bp, Artificial
  synthetic
atggacaaaaaatacagcatcgggctcgacattggaactaattccgttgggtgggccgtgatcaccgatgagtataaggtgccatctaagaaattcaaggtcctcgggaataccgacaggcacagcataaagaagaacttgatcggggccctcctcttcgacagcggggaaaccgccgaagccacaaggcttaaaaggacagccaggaggaggtacaccaggaggaaaaataggatatgctacctccaagagatatttagcaatgagatggccaaagtcgatgacagcttcttccataggctcgaggaatccttcctcgtcgaggaggacaaaaagcacgagaggcaccccatcttcgggaacatagttgacgaagtcgcataccacgagaaataccccactatatatcacctcaggaaaaagctcgtggactccaccgataaggcagacctcaggctcatctatctcgccttggcccacatgatcaaattcaggggtcacttcctcatcgagggcgaccttaaccccgacaacagcgacgtggacaagctcttcatccagctcgtccaaacctacaaccagttgtttgaggagaaccctatcaacgccagcggcgtggatgccaaggccatcctctccgccaggctttccaagagcaggaggttggaaaacctcatcgcccaattgcccggcgagaaaaagaacggcctcttcggcaatctcatcgccctttcccttggcctcacacccaatttcaagtctaacttcgatctcgctgaggatgccaagctccagcttagcaaggacacctatgacgacgacctcgacaatttgctcgcacagataggggaccaatatgccgatttgttcctcgccgcaaagaacctcagcgatgccatcctcctcagcgatatcctcagggtcaacaccgaaataaccaaagcccccttgtccgcttccatgatcaagaggtatgacgagcaccaccaggatctcaccttgctcaaggccctcgtgaggcagcagcttcccgagaagtataaagagatctttttcgaccagtccaagaatgggtacgctggatacatcgacgggggggcttcccaggaggagttttacaagttcatcaagcccatcctcgagaagatggacggcaccgaggagctcctcgtcaaactcaacagggaggatctcctcaggaagcaaaggacctttgataacgggagcatcccccaccaaattcatctcggggagctccacgccatcctcagaaggcaagaggacttttatcccttcctcaaggacaacagggagaaaatcgaaaagattctcacctttaggatcccctactacgtcgggcccctcgccaggggtaactcaagatttgcctggatgaccaggaaaagcgaggagactatcaccccctggaacttcgaagaggtcgttgataaaggcgccagcgcccagtccttcatcgaaaggatgaccaactttgacaagaatctccccaacgaaaaagtccttcctaagcactcactcttgtacgagtacttcaccgtctacaatgaactcaccaaggttaaatacgtgaccgagggaatgagaaagcccgccttcctcagcggggaacagaagaaggccatcgttgacctcctcttcaagacaaacaggaaagttaccgttaagcagctcaaggaggactactttaagaagattgaatgcttcgatagcgttgagatctccggcgtcgaggacagattcaacgccagtctcggaacctaccatgacctcctcaagatcatcaaggacaaagacttcttggataacgaggagaacgaggatatccttgaggacatcgtgctcacccttacccttttcgaagacagggagatgatcgaggaaaggctcaagacctacgcccacctcttcgacgacaaggtcatgaagcaactcaagaggagaaggtacaccggttggggcaggctctccaggaagcttatcaatggtattagggacaagcagagcggaaaaactatcctcgacttccttaagagtgatggatttgctaataggaatttcatgcagctcatacacgacgacagcctcaccttcaaggaagatatccaaaaggcccaggtttcaggccagggagatagcctccatgaacacattgctaatctcgcagggagtccagccatcaagaaagggatcttgcagaccgtgaaggttgtggatgagctcgtgaaggtcatggggaggcataagcccgagaacatcgttatcgagatggccagggagaaccaaaccacacagaaggggcaaaagaacagcagagagaggatgaaaagaattgaagaaggaatcaaggaactcgggagtcagatcctcaaagagcaccctgtggagaacacccagcttcagaacgagaagctctacctctactacttgcagaacggaagggacatgtacgtcgaccaggagctcgacatcaacaggctcagtgattacgacgtcgaccatatcgtcccacaatccttccttaaggacgacagcatagacaacaaagtgcttacaaggagcgataagaacagaggtaagagtgacaacgtcccatccgaggaggtcgtcaagaagatgaagaactactggaggcaacttctcaacgctaagcttatcacacagaggaagttcgataaccttaccaaggccgagagggggggactttccgaacttgacaaggccgggttcatcaagagacagctcgtcgagaccagacaaatcaccaaacacgtcgcccagattctcgatagcaggatgaataccaagtacgacgagaacgacaaactcatcagggaggtgaaggtgataaccctcaagagcaagctcgtctcagactttaggaaggacttccagttttacaaggtcagggaaataaacaactaccatcatgcccacgacgcctatctcaacgccgtggtcggcaccgccctcataaagaagtaccctaaactcgagagtgagttcgtctacggcgactacaaagtctatgatgtcaggaaaatgattgcaaagtccgaacaggagattggaaaggcaaccgccaagtactttttctactcaaacattatgaacttcttcaagaccgagataaccctcgcaaacggcgaaatcaggaagaggccccttatcgagaccaacggcgagactggtgaaatcgtttgggataagggcagggacttcgccaccgtcaggaaggtgctctccatgccccaggtgaacatcgtgaagaagacagaggtccaaactggcggcttctccaaggaatccatcttgccaaaaaggaactctgacaagctcatcgccaggaaaaaggactgggaccccaagaagtacgggggcttcgactcccccactgtcgcctactccgtcctcgtggttgctaaggtggagaaggggaagagtaagaagctcaaaagcgtcaaggagctcctcggcatcactatcatggagaggtcaagtttcgagaagaaccccatcgatttcttggaggccaaggggtacaaagaggtcaagaaggacctcatcatcaagctccccaagtactctctcttcgagcttgagaacgggaggaagaggatgctcgcctccgccggggagttgcagaagggaaacgagctcgccctccccagcaagtatgtgaacttcttgtacctcgcctcacactacgagaagctcaaaggatcccccgaggataacgagcagaagcagctcttcgttgaacagcataagcactacttggacgagatcattgaacaaatctctgagttctccaaaagggttatactcgccgacgccaacctcgataaagtgcttagcgcctacaataagcacagggataaacccatcagggaacaggccgagaacataatccacctcttcaccctcaccaaccttggggctccagcagccttcaagtatttcgataccaccatcgataggaagagatatacctcaaccaaggaagtcctcgacgccactcttatccaccagagtatcaccggcttgtacgagaccaggattgatctctcccagctcggcggtgac

SEQ ID NO: 12 - DNA, 4104 bp, Artificial
  synthetic
atggacaagaaatacagcattggcctcgacattggaaccaactcagtgggctgggccgtgatcaccgacgagtacaaggtcccctccaagaaatttaaagttctcggtaacaccgacaggcactccattaagaagaaccttattggcgccttgctcttcgactctggcgaaaccgccgaggccacaaggctcaaaagaacagcaaggaggaggtacaccaggaggaagaataggatctgctacctccaagaaatcttcagtaacgagatggctaaggtcgacgattccttctttcacagactcgaggagtccttccttgtggaggaagacaagaagcatgaaaggcaccccatcttcggtaacatagtcgacgaggtggcctaccacgagaagtaccccacaatctaccatctcagaaaaaagttggtcgactccaccgacaaggccgatctcaggcttatctacctcgccttggctcacatgatcaagtttaggggccatttcctcatcgagggcgacctcaatcccgataacagcgacgtcgacaagctctttatccagctcgttcagacatacaatcagttgttcgaggaaaaccccatcaacgccagcggcgtcgatgccaaggcaatcctttccgcaaggctctctaagagcagaaggctcgaaaatctcatcgcccaacttcccggcgagaagaagaatgggctctttggtaacttgatcgccctctcactcgggctcacacccaacttcaagagcaatttcgatctcgcagaagacgctaagctccagctctccaaggatacctacgatgatgacctcgacaacctccttgcccagattggggaccagtacgccgacctctttcttgccgccaagaacctcagcgacgccatactcctctccgacatcctcagggttaataccgaaataaccaaggcccccctcagtgcctccatgatcaagagatacgacgagcaccaccaagacctcacactcctcaaagccctcgtcaggcagcagctccccgagaagtacaaagagatctttttcgatcagtccaagaatggctatgccggctacatcgatggcggggcctctcaggaggagttctacaaattcatcaaacccatcctcgagaagatggacggaaccgaggagctcctcgtcaagctcaacagggaggacctcctcaggaagcagaggacgttcgacaacgggagcatcccccaccagattcatctcggcgagctccacgctatactcaggaggcaggaagatttctaccccttcctcaaggacaacagggagaagatcgaaaagatcctcaccttcaggattccttactacgttgggcccctcgccagaggcaacagcaggttcgcatggatgaccaggaaatctgaggagaccatcactccctggaactttgaggaggttgtcgacaagggggcctccgctcagagcttcatcgagaggatgaccaactttgataagaatctccctaacgagaaggtcctccctaaacattccctcttgtacgaatacttcaccgtctacaacgagctcaccaaagtcaagtatgtcactgaggggatgagaaagccagccttcctcagtggggaacagaaaaaagccatcgtcgacctcctcttcaaaaccaacagaaaggttaccgtgaaacagctcaaggaggactatttcaaaaaaatagaatgtttcgattccgttgagatctcaggcgttgaggacaggttcaacgccagccttgggacctatcacgacctccttaagatcatcaaggataaggattttctcgacaatgaggagaacgaggatatcctcgaggacatcgtcctcaccttgaccctcttcgaggacagggagatgatcgaggagaggctcaagacctacgctcacctcttcgacgacaaggttatgaagcagctcaagaggaggaggtacaccggctggggcaggctttcaagaaaacttatcaacgggataagggacaagcagtccggcaagaccatcctcgatttcctcaagtctgacggcttcgccaacaggaacttcatgcagctcatccatgacgactccctcaccttcaaggaagacatccagaaagctcaggtctcaggacagggcgacagcctccacgagcacatcgccaacctcgccggatcccccgccattaagaagggaatattgcaaaccgttaaagttgtggacgagctcgttaaggttatggggaggcataaacccgagaacatcgtgatcgagatggccagggagaaccagacaacccagaagggacaaaagaatagcagagaaagaatgaagaggatcgaggagggaatcaaggagttgggttcccagatactcaaggagcaccccgtggagaacacccagttgcagaacgaaaagctctacctctactatcttcagaacggcagggacatgtacgtggatcaggagctcgatatcaacagactctccgactatgacgtggaccacatcgttccacagagctttcttaaagacgacagcatcgataacaaagttctcaccaggagcgataagaacaggggcaaatccgacaatgttcccagcgaagaagtcgtgaaaaagatgaagaattactggagacagcttctcaatgccaaactcatcacccagagaaagttcgacaacctcaccaaggccgagaggggtgggctcagcgagctcgacaaggccggctttataaagagacagctcgtggagaccaggcagatcactaagcatgtggcccagatcctcgactccaggatgaataccaaatacgacgagaatgacaagctcatcagggaggtcaaagtgatcaccctcaagtccaagctcgtgtccgacttcaggaaagattttcaattttacaaagtgagagagatcaataactatcaccacgcccacgatgcctacctcaatgccgtggtgggaacagcccttatcaagaaataccctaagctcgaatccgagttcgtgtacggagactataaggtctacgacgtgagaaaaatgatcgcaaagtccgagcaggagatcggcaaggccaccgcaaagtactttttctacagcaacatcatgaacttcttcaagaccgagatcaccctcgccaacggcgagatcaggaagaggcctctcatcgagaccaatggggagaccggggagattgtttgggacaaggggagggactttgccactgtgaggaaggttttgagtatgcctcaggtgaacatcgtcaagaagacagaggttcagacaggcgggttttccaaggagagtattttgcccaaaaggaactccgacaagctcatagccaggaagaaagactgggaccccaaaaagtacgggggctttgacagccccactgtggcctatagcgtccttgtcgtggccaaggtcgagaaggggaagtccaagaagctcaagagtgtgaaggagctcctcggcatcaccatcatggaaaggtccagcttcgagaagaaccccatagatttcctcgaggccaaggggtacaaggaggtgaagaaggacctcatcatcaagctccccaagtacagcctcttcgagctcgaaaacggtaggaagaggatgctcgcctctgccggagagctccagaagggcaacgagctcgccctccccagcaagtacgtgaacttcctctacctcgccagccactacgagaagctcaaggggagccccgaagacaacgagcagaagcagctctttgtggagcaacacaaacactacctcgacgaaattatcgagcagatctccgagtttagcaaaagagtcatcctcgctgacgccaaccttgacaaggtgctctctgcctataacaagcacagggacaagcctatcagggagcaggccgagaacatcatacatcttttcaccttgaccaacctcggagcccctgccgccttcaagtacttcgacaccacaatcgataggaagaggtacaccagcactaaggaggttttggacgccaccctcattcaccaaagcatcaccggactctacgagaccaggatcgaccttagccaactcggaggcgac

SEQ ID NO: 13 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 14 - DNA, 3159 bp, Artificial
  synthetic
atgaagaggaactatatactaggcctcgacataggtatcaccagcgtgggctacggcatcatagattatgagactagggacgtgatagatgctggtgttaggctattcaaggaggcgaatgtcgagaacaatgaaggacgtagatcaaagcgcggcgcacgccgcctgaaacgcagaaggcgacacaggattcagagggtgaagaaactgttgttcgactacaatttgcttactgaccattcagagctttccggtatcaatccttacgaggctcgtgtgaaaggcctcagccaaaaattgtccgaagaagaattttccgctgcacttctgcacctggcaaaacgacgtggtgtccataacgtcaatgaagttgaagaggataccgggaatgagttgagtacaaaagaacaaattagtagaaatagtaaagctttagaggaaaaatatgtcgctgagctccaattagaaagattaaagaaggatggtgaggttaggggttccataaatcgttttaagacaagtgattacgtcaaagaggcaaagcaacttcttaaagtacagaaggcatatcatcaattggatcaatcctttatcgatacatacatcgatcttcttgagactcgtagaacttactatgaaggcccaggcgagggttctccatttggctggaaggatataaaagagtggtatgaaatgctgatgggtcattgtacctactttccagaggaactaaggtctgttaagtatgcttataacgccgatctttataacgccctcaatgacctgaataacctagttattactagggacgaaaatgaaaagttggaatattatgaaaagttccagattattgagaacgttttcaaacaaaagaagaaaccgaccctaaaacagatagctaaggaaattttagtcaacgaagaggatattaagggataccgtgttacaagcactggcaaacctgaatttaccaatctcaaagtttatcatgatattaaagacattaccgcccggaaagagataattgaaaacgctgaacttttagaccagattgcgaagattttgactatatatcaatcctcagaggatatccaggaggagttaacgaatctcaactcagagcttacccaagaagagatagagcagataagtaacttgaagggatacactgggactcataatctctcgctgaaggcaataaatttgatccttgatgaattatggcataccaatgataatcaaatagctattttcaacaggctaaagttggtgcctaagaaggttgatttgagccaacaaaaggagatcccaacgactttagtcgatgatttcattctgagcccagtagtgaagcggtcattcattcaatcaatcaaggttataaatgccattattaagaagtacggcttacctaacgatattataatcgaactcgccagagaaaaaaatagcaaggatgcccagaaaatgatcaacgaaatgcaaaagagaaatcggcagactaatgagagaatcgaggaaatcatcaggaccacaggtaaggagaatgcaaaatacctgattgaaaagatcaaattgcatgacatgcaagagggaaagtgcttgtattccctcgaagcaatccccctcgaggatcttcttaacaaccctttcaactatgaggttgatcacattattcctaggtctgtgtcattcgataatagcttcaataacaaagtgcttgtgaagcaggaagagaactcaaaaaaagggaacagaacccccttccagtacctcagttcctctgattccaaaatttcttatgaaacttttaaaaagcacattttgaacctagcaaagggtaagggaagaatttctaagacaaagaaagagtatcttttagaggagcgggatattaataggtttagtgtgcaaaaagatttcataaacagaaaccttgttgacaccagatatgccacccggggtcttatgaatttacttagatcgtacttccgggtgaacaatttggacgttaaggtgaagtcaatcaatgggggcttcacctcatttctaaggcggaaatggaagtttaaaaaagaacgtaataaggggtacaagcatcacgcagaagatgcactcattattgcaaacgcggattttattttcaaagagtggaagaaactcgataaagcaaaaaaagttatggaaaaccaaatgttcgaggaaaaacaagctgaatctatgcctgaaatagagacggagcaagaatacaaggagattttcatcactcctcatcagattaagcatataaaggacttcaaggattataagtatagccatcgcgtggacaaaaagcctaatagagagcttatcaatgatactctttattcaacccgtaaggatgataaaggtaataccttgattgtcaataatctcaatggtctgtacgataaagacaatgacaaacttaagaaactcattaataaatctccagaaaagctgcttatgtatcaccacgacccgcaaacatatcaaaagttgaagctgataatggagcaatatggagatgagaagaaccctctctataaatattatgaggagaccggaaactatcttacaaaatactccaagaaggataacggaccggttataaaaaagattaaatactacggtaataaacttaacgctcatctcgacataactgatgattatcccaattcacgcaacaaggtggtaaagttgtccctcaaaccatacaggttcgacgtttaccttgataacggggtatacaagttcgttaccgttaagaaccttgacgtcattaagaaagagaactactatgaggttaatagtaagtgctatgaagaagctaaaaaactaaaaaaaatatccaaccaggcagaatttatcgcatcattttacaataacgatcttataaagattaacggcgaactctacagggtgattggtgtgaataatgatcttctgaatcgaattgaggtgaacatgattgatatcacttacagggagtatcttgagaacatgaatgataagcgccccccaaggatcattaaaactatagcatcaaagacccaatcgataaagaaatacagtacagatatattggggaatctatacgaggttaaatctaagaaacacccccaaattatcaaaaaaggt

SEQ ID NO: 15 - DNA, 3159 bp, Artificial
  synthetic
atgaaaaggaactatatcctcggcctcgacataggtattaccagcgtcggctacggcattatcgactacgagacaagagatgtcatcgacgccggggtgaggctctttaaggaggccaacgttgaaaacaatgaaggcaggagatctaagagaggagccaggagacttaagagaaggaggaggcacaggatccagagggtcaaaaagctcctcttcgattacaacttgcttaccgatcatagcgagctctccggcatcaacccctacgaggccagggtgaagggcctcagtcagaaactctcagaggaggagttcagcgccgcccttctccacttggccaagaggaggggcgtgcacaacgtgaatgaggtcgaggaagacaccgggaacgagctctctaccaaggagcagatcagcaggaacagtaaggcccttgaggagaagtacgtcgccgaactccagctcgagaggcttaagaaggacggcgaggtgagaggctccatcaacaggttcaagaccagcgactacgttaaggaagccaaacaactcctcaaggttcaaaaggcctatcaccaactcgatcagagcttcatagacacttacatcgacctcctcgagaccaggaggacctactacgaggggcccggcgaggggtccccctttgggtggaaggacatcaaagagtggtacgagatgctcatggggcactgcacttacttccccgaagagttgaggtccgtcaagtatgcctataatgccgacctctacaacgcactcaatgacttgaataacctcgtgatcacaagagatgagaacgagaaactcgaatactacgagaagttccaaatcattgagaatgtcttcaaacaaaagaagaagcccaccctcaagcagatcgccaaggaaatcttggtcaacgaagaggacatcaaaggttacagggttacaagcaccggcaagcccgagttcactaacctcaaggtgtaccatgacatcaaggacatcaccgccaggaaagaaatcatcgaaaacgccgagctcctcgatcagatcgccaaaatactcaccatctaccagtccagcgaggacattcaggaggagctcaccaacctcaattctgagttgacccaagaggagattgaacagatctccaacctcaagggctacactggaacccataatctcagcttgaaggctatcaacctcatcctcgatgagctctggcacactaatgacaaccagatcgccatcttcaacaggctcaaactcgtccccaagaaagtcgaccttagccagcagaaagagatccccaccaccctcgtcgacgactttatcctttcccccgtcgttaagaggtccttcatccagagtatcaaagtcatcaacgccatcataaaaaaatacggactccccaacgacatcatcatcgaactcgccagggagaagaacagcaaggacgcccagaagatgattaatgagatgcagaagaggaacaggcaaaccaatgaaagaattgaagagattatcagaaccaccggcaaagagaacgcaaagtaccttatcgagaaaatcaaactccacgacatgcaggagggcaagtgcctctattctctcgaagccatccccctcgaagacctcctcaacaaccccttcaactacgaagtcgatcacatcatacccaggagcgttagcttcgacaacagcttcaataacaaagtgctcgttaagcaggaggagaacagcaaaaagggaaataggaccccctttcagtacttgtcaagtagcgattccaagatcagctacgaaaccttcaaaaagcacatcctcaaccttgctaaggggaaggggaggatcagcaagaccaaaaaggagtacctcctcgaagagagggacatcaacaggttcagcgtccagaaagacttcatcaatagaaatctcgttgacaccaggtacgccactaggggcctcatgaatctcctcaggagctacttcagggtgaataacctcgacgtgaaagtgaagtccataaacggcgggttcacctccttcctcaggaggaaatggaagttcaagaaggagaggaacaaggggtataagcaccacgccgaggacgccttgatcattgccaatgctgacttcatctttaaggaatggaagaaattggacaaggccaagaaggtgatggagaaccagatgtttgaggagaagcaggccgagagcatgcccgagatcgagaccgagcaggagtataaggagatcttcatcaccccccatcagatcaagcacatcaaggacttcaaggactataagtactcccatagagtcgacaagaaacctaacagggagctcatcaacgataccctctatagcaccaggaaggatgacaagggaaacacactcatcgtcaacaacctcaacggcctctacgataaagacaacgacaagctcaagaagctcataaacaaaagccccgagaagttgctcatgtaccaccacgacccccaaacttaccagaagctcaagctcatcatggagcagtacggcgacgagaagaacccattgtataaatactacgaagagaccgggaactacctcaccaagtactctaagaaggacaacggccctgttattaagaagatcaaatactatggcaacaagctcaacgcccacctcgacatcaccgacgactatcccaattccagaaataaggtcgtcaagctctccttgaagccttacaggttcgacgtttacctcgacaacggcgtttacaagttcgtgaccgtcaagaacctcgacgtcatcaaaaaggaaaactattatgaggtcaacagcaagtgctacgaagaggccaagaaactcaagaagataagcaaccaggccgaatttatcgcctccttctacaacaatgacctcatcaagatcaatggcgaactttacagggtcattggtgttaacaacgatctcctcaacaggatcgaggtcaacatgatcgacatcacctacagggaatatttggaaaacatgaacgacaaaaggccccccaggatcataaagaccatcgccagcaagacacagagcatcaagaagtattccacagatatcctcggtaacctctacgaggttaagagcaagaagcacccccagatcatcaaaaaaggg

SEQ ID NO: 16 - DNA, 3159 bp, Artificial
  synthetic
atgaaaaggaattacatcctcggtctcgacatcggcatcacctctgtcgggtacggcatcatcgattatgagaccagggatgttatcgacgccggcgtgaggctcttcaaagaggccaacgtcgaaaataacgagggtagaaggagcaagaggggcgccagaaggcttaagaggagaaggaggcacaggatccagagagtcaagaagttgctttttgattataatctcctcaccgaccattcagagctctctgggatcaatccctatgaggccagggtgaagggcttgagccagaagctcagcgaggaagagttctctgccgccctcctccacctcgctaagaggaggggggtgcacaatgtcaacgaagttgaggaggataccggtaacgagctctccaccaaggaacagatttccaggaactcaaaggcccttgaggagaaatacgttgccgagttgcagctcgagaggctcaagaaggatggggaggtcagaggttccatcaataggtttaagactagcgactacgttaaggaggccaagcagctcctcaaagtccagaaggcctaccaccagctcgaccagagtttcatcgatacctacatcgatttgttggagaccagaaggacctactatgagggccccggggagggcagcccctttggatggaaggacatcaaggaatggtacgagatgctcatgggccactgcacctactttcccgaagaattgaggtctgtgaagtacgcctacaacgccgacctttataacgccctcaacgatttgaacaacctcgtgatcaccagggacgagaacgagaagctcgagtactacgagaaattccagatcatcgagaacgtgtttaagcaaaagaagaagcctacccttaagcagatcgccaaggagatacttgtcaacgaggaagatattaagggatacagagttaccagcactggcaagcccgagttcaccaacttgaaggtgtaccacgatatcaaggatatcactgccaggaaagagataatcgagaacgccgagctcctcgaccagatagcaaagatcctcaccatctatcagagcagcgaggatatccaggaggagctcaccaacctcaactccgagctcactcaggaggagatcgagcagatctccaacctcaaaggctacaccgggacccacaacttgtccctcaaggccatcaatcttatcctcgatgagctctggcacaccaacgacaaccaaatcgccatcttcaacaggctcaagctcgtccccaagaaggtggacctttcccaacagaaggagatccccaccaccttggtcgatgacttcatccttagccctgtcgtcaagaggagctttatccaatccatcaaggttatcaacgccataataaagaagtacggtctccccaacgacatcatcatagagctcgcaagagagaagaacagcaaggacgcacaaaagatgatcaacgaaatgcagaaaaggaacaggcagactaatgaaaggatcgaggagatcatcaggaccaccggaaaggagaacgccaagtacctcatcgagaagatcaaactccacgacatgcaagaaggtaaatgcctctacagcctcgaggccatccccctcgaggacctccttaacaaccccttcaattacgaagtcgaccacatcatcccaaggtccgttagcttcgacaacagtttcaacaacaaagtgctcgttaagcaggaggagaacagcaagaagggcaacaggacacccttccaatacctctcatcctcagattccaaaatcagctacgaaactttcaagaaacacatcctcaacctcgccaaagggaagggaaggatcagcaagaccaagaaggagtacctcctcgaagagagggacatcaacagattctccgttcagaaggacttcatcaataggaacttggttgacaccagatacgccaccagggggcttatgaaccttctcaggtcctattttagggtgaacaacctcgacgtcaaagtcaagagcatcaacggtgggttcaccagcttcctcaggaggaagtggaagtttaagaaagagaggaacaaggggtacaaacaccacgccgaggacgccctcattatcgccaacgccgacttcatcttcaaagagtggaagaagctcgacaaggccaagaaagttatggagaatcagatgttcgaagagaaacaggcagagagcatgcctgagatcgagaccgagcaggaatacaaggagattttcatcaccccccaccagattaagcacattaaggacttcaaggattacaagtatagtcacagggtggacaagaaacccaacagggagctcatcaatgacactctctacagcaccaggaaggacgacaaaggcaacacccttatcgtcaacaatctcaacgggctctacgacaaggataacgacaagttgaagaagctcattaacaaatcacccgagaagctcctcatgtaccatcacgaccctcagacctaccagaagctcaagctcatcatggagcagtacggtgacgagaaaaaccctctctacaagtactatgaggagactgggaactacctcaccaagtacagcaagaaggacaacggccctgtcattaagaagatcaagtactatggcaacaagttgaatgcccacctcgacatcaccgatgattaccccaactcaagaaacaaagtggtcaaactcagcctcaaaccatataggtttgacgtttacctcgataatggtgtttacaagtttgttaccgtgaagaacctcgacgtgatcaagaaggagaattattatgaggttaattctaaatgctatgaggaagccaagaaactcaagaagatcagcaaccaggccgagttcatcgccagcttctacaacaatgacctcatcaaaatcaacggtgaactctacagggtgatcggcgtgaataatgacctcctcaacaggatcgaggtcaacatgatcgacatcacctacagggagtacttggaaaacatgaacgacaagagacctccaagaatcataaagaccatcgccagtaagacccaatccatcaagaagtacagcaccgacatccttgggaacctctatgaagtcaagtccaagaagcatccccagatcattaagaaggga

SEQ ID NO: 17 - DNA, 3159 bp, Artificial
  synthetic
atgaagaggaactatattctcggactcgacatcgggattacctccgtggggtacggcatcatcgattacgagaccagagacgtgatcgatgccggggtgagactcttcaaagaagccaacgtggagaacaatgaggggaggagaagcaaaaggggtgccaggaggttgaagagaaggaggagacataggatccaaagagtgaagaaattgctttttgattacaatctcctcaccgaccactccgagctctccgggataaacccctatgaagccagggtcaagggcctctctcagaagcttagcgaagaggagttcagtgccgccctcctccacttggctaaaaggaggggggtgcacaatgttaacgaggtcgaggaggacaccggcaacgagctctctaccaaggagcagatctccaggaactctaaggccttggaagagaagtacgtggctgaactccagctcgaaaggctcaagaaggatggggaggtcagaggctccattaacaggttcaaaacctccgactacgtcaaggaggccaaacagctcctcaaggtgcagaaggcctaccaccagctcgatcagagcttcatagacacctacatcgacctcctcgaaaccaggaggacatactacgagggtcccggcgagggttcccccttcgggtggaaggatatcaaggagtggtacgagatgctcatggggcactgcacctacttccccgaggagctcaggtctgttaagtatgcctacaacgccgacctctacaacgcactcaacgaccttaacaatttggtcatcactagggacgagaacgagaagctcgaatactacgagaagttccagatcatcgagaatgttttcaaacagaagaagaaacccaccttgaaacagatcgctaaagagatactcgttaacgaggaggacatcaaagggtatagggtcaccagcaccgggaagcccgagtttaccaatctcaaagtttaccacgatatcaaagatatcaccgccaggaaggaaatcatcgagaacgccgaacttcttgaccagatagccaagattctcaccatctatcagtcctcagaggatatccaagaggagctcaccaaccttaactccgagcttacccaagaggagatcgaacagatcagtaacttgaagggctataccgggacccacaacctttcactcaaggccatcaacctcatcctcgacgagctctggcatactaacgacaaccagatcgccatcttcaacaggctcaagctcgtgcccaagaaggtggacctctcccaacagaaggagatacccaccaccctcgttgatgactttatcctcagccccgtcgtcaagaggtcttttatccagagcatcaaggtcatcaacgccataatcaagaagtacggcctccccaacgacatcatcatcgagctcgctagggagaagaatagcaaggacgcccagaagatgataaacgagatgcagaagaggaacaggcagactaacgagaggattgaggaaataatcaggaccactgggaaagaaaacgccaagtatttgatcgaaaagatcaagctccatgacatgcaggagggcaagtgcttgtactccctcgaggccatccccctcgaggatctccttaacaaccccttcaactacgaggtggatcacatcatccccaggtccgtttccttcgacaactctttcaacaacaaagtccttgtgaagcaggaggaaaactccaagaaggggaacagaacacccttccagtatctctcatcctcagattcaaagatctcctacgagacctttaagaagcacatcctcaacctcgccaaggggaagggcaggataagcaagaccaagaaagagtatctcttggaggaaagggacataaataggtttagcgtgcagaaggactttatcaacaggaatctcgttgacaccaggtacgccaccagagggctcatgaatctcctcaggtcctacttcagggtgaacaatctcgatgtgaaggtcaagtccatcaacgggggcttcacctccttcctcagaaggaaatggaagttcaagaaagaaaggaacaagggatacaagcatcatgccgaggacgcccttatcatcgccaacgctgactttatattcaaggagtggaagaagctcgataaagccaagaaggtgatggagaaccagatgttcgaggagaagcaggccgagtccatgcccgagatcgagaccgagcaggaatataaagagatctttatcaccccccaccagatcaagcacataaaggacttcaaagattacaagtactcccacagagtggacaagaagcccaacagggagctcatcaacgacaccctctactccaccaggaaggacgataagggaaacaccttgattgtcaataacctcaacggcctctacgacaaggacaatgataagctcaagaagctcatcaacaagagccccgagaagcttctcatgtaccaccacgacccccagacctatcagaagctcaagctcatcatggagcagtacggcgacgagaagaaccccctctacaagtactacgaggagaccggaaactatctcaccaagtacagtaagaaggacaacgggcccgtcatcaagaagattaaatactatggaaacaagctcaacgcccaccttgacatcaccgacgattaccccaattccaggaacaaggtcgtgaagctctccttgaaaccctataggttcgacgtctatttggacaacggtgtgtacaagttcgttaccgttaaaaacctcgacgtgatcaagaaggaaaactactatgaggttaacagcaagtgctatgaggaggccaagaagctcaagaagattagcaaccaggcagagttcatcgcttccttttacaacaacgatctcatcaagatcaacggtgagctctatagggtcatcggcgtgaataatgacctcctcaacaggattgaagttaatatgatcgacatcacctacagggagtaccttgagaacatgaacgataagagaccccccagaatcataaaaaccatcgcctccaagacccagagcataaagaagtattcaaccgatatcctcggcaacctctatgaggtgaagtccaaaaagcacccccagatcattaaaaagggc

SEQ ID NO: 18 - DNA, 3159 bp, Artificial
  synthetic
atgaagaggaactacattctcgggctcgacatcgggatcacctcagtcgggtacgggattatcgactacgagaccagagatgtgatcgacgccggcgtcaggctcttcaaggaagcaaacgttgagaacaacgaggggaggagatccaagagaggagccaggcgcctcaaaagaaggagaaggcacaggatccagagggtgaagaaactcctctttgactacaacctcctcaccgaccatagcgagctctctggaatcaacccctacgaggccagggtgaaaggcctctctcagaagttgtcagaggaagagttcagcgccgccttgttgcacctcgcaaagaggaggggcgtgcataacgtcaatgaagttgaagaggataccggcaacgagctctcaaccaaggagcaaataagcagaaatagtaaagcacttgaggagaagtacgtggctgaactccaactcgagaggctcaaaaaggacggcgaggtcaggggtagcattaataggtttaaaacctccgattacgttaaggaagcaaagcaattgcttaaggtccaaaaggcctaccaccagctcgatcaaagcttcatcgacacctacatagacctccttgagaccaggagaacatactacgaaggccccggcgaggggtcccccttcggttggaaggacattaaggagtggtacgagatgctcatgggacattgcacctacttccccgaagaactcaggagcgtgaagtacgcctacaacgccgacctctacaacgcccttaacgatttgaacaatctcgtcatcactagggacgagaatgaaaagctcgagtactacgaaaagttccagatcatcgagaatgtcttcaagcagaagaagaagcccaccttgaagcagatcgccaaggagatcctcgtgaatgaggaggacatcaaggggtacagggtgaccagcaccggtaaaccagagttcaccaacttgaaggtctaccacgatatcaaggacatcaccgccaggaaagaaatcatcgaaaatgccgaactccttgaccagatcgccaaaatcttgacaatctaccagagcagcgaggacatccaagaggaactcaccaaccttaatagcgagttgacccaggaggagatcgaacagatctccaaccttaaaggctacaccggcacccataacctctccttgaaggccatcaacctcatcctcgacgagctttggcacaccaatgacaaccaaatcgccatcttcaacaggcttaagctcgttcccaagaaggttgacctcagccagcaaaaggagatacccaccactctcgtcgatgatttcatcctctctcccgttgtgaagaggtccttcatccagtccattaaggtgatcaacgccatcattaaaaagtacgggctcccaaatgacataattatcgagcttgcaagggagaagaattccaaggacgcccagaagatgatcaacgaaatgcagaagaggaataggcaaacaaacgagaggatcgaggagatcatcagaacaaccgggaaagagaacgccaagtacctcatcgaaaaaatcaagctccacgacatgcaggagggcaaatgtctctacagtctcgaggccatacccctcgaggacctcctcaacaacccatttaattatgaagtggaccacatcatccccaggtccgtgtccttcgataactccttcaacaacaaggtgctcgtcaagcaagaagaaaatagcaagaagggtaacaggacccccttccaatacctctcaagctccgattctaagatcagctatgagaccttcaagaaacacatccttaacctcgccaaggggaaaggaaggataagcaaaactaaaaaggagtatctcctcgaagagagggatatcaacaggtttagtgtgcagaaagactttatcaatagaaacctcgtggacaccaggtacgccaccagaggtctcatgaacctcctcaggagctacttcagggtgaacaatctcgacgttaaggttaagtctatcaacgggggctttaccagcttcctcaggaggaagtggaagtttaagaaggaaagaaacaagggttataagcaccacgccgaggacgccctcatcatagccaacgctgacttcatcttcaaggaatggaagaagctcgacaaggccaaaaaggtgatggagaaccagatgtttgaggaaaagcaagccgagagtatgcccgagattgagacagagcaagagtataaggagattttcatcaccccccaccagatcaagcatatcaaagacttcaaggactacaagtacagccatagggtggacaagaagcctaacagggagctcatcaatgacaccttgtattctaccaggaaagatgataaggggaacaccttgatcgttaacaacctcaacggcctctacgacaaggataacgacaagctcaagaagctcatcaacaaaagtcccgaaaagctcttgatgtaccatcacgacccacagacctaccagaagttgaagctcatcatggagcagtacggggacgaaaagaaccccctttacaagtactacgaggaaaccgggaactacctcaccaagtactctaagaaagacaatggccccgtcatcaagaagatcaagtattacgggaataagcttaatgcccaccttgatatcaccgacgactaccccaactccagaaacaaggttgttaaactctccctcaaaccatatagatttgacgtctacctcgacaacggagtctacaagttcgtcaccgtgaaaaaccttgatgtcatcaaaaaggagaactattatgaggtgaatagcaaatgctatgaagaggccaagaagttgaagaagatctctaatcaagctgagttcatcgccagcttctataacaatgacctcattaaaatcaacggcgagctttacagagtgatcggagtgaacaacgacctcctcaacaggatcgaggttaacatgatcgacataacctacagggagtacctcgagaacatgaacgacaagaggccaccaaggatcatcaaaaccatcgccagtaagacccagagcattaaaaaatacagcacagacatcctcggcaatttgtacgaagtgaagagcaagaagcacccccagatcatcaagaagggg

SEQ ID NO: 19 - DNA, 3159 bp, Artificial
  synthetic
atgaagaggaactatatcctcggactcgacattgggatcactagcgtcgggtacgggatcatagactacgagactagagatgtgatcgacgccggcgtcaggcttttcaaagaggccaacgttgaaaacaacgaagggagaaggtccaagagaggcgccaggaggctcaagaggaggaggaggcataggatccagagagtgaagaagttgctcttcgattacaatctcctcaccgatcactccgagctcagcggcatcaatccctacgaggccagggtgaagggattgagccagaagctctccgaggaggagttctccgcagcactccttcacctcgccaaaagaaggggagtccataacgttaacgaagtggaggaggacaccggcaatgagctcagcaccaaagagcagatcagcagaaactccaaggcacttgaggagaagtatgttgccgagttgcagttggagaggctcaagaaggacggcgaggtgagggggagcatcaacaggttcaaaacctccgattacgttaaagaggccaaacagctccttaaggtccagaaagcctaccatcagttggaccaaagcttcatagacacctacattgacctcctcgagaccaggaggacctactacgagggtcctggagaggggagcccattcgggtggaaggacatcaaggagtggtacgagatgctcatgggccactgtacctacttccccgaagagctcaggagcgttaagtacgcctacaacgccgatctctacaacgccctcaatgacctcaacaacctcgttatcaccagggacgagaacgagaaactcgaatactacgaaaaatttcagataatcgaaaatgtcttcaagcagaagaagaaacccacactcaagcagatcgccaaggaaatcctcgttaacgaagaggacattaagggttatagggtgaccagcaccggtaagcctgagttcaccaacctcaaagtgtaccacgatataaaggacataacagctaggaaggagataatcgagaacgccgagcttctcgaccaaatcgcaaaaatccttaccatctaccagtcctccgaggatatccaggaagaactcacaaaccttaactccgaactcacccaggaagagatcgagcagatctccaacctcaaagggtataccgggacccacaatctcagcttgaaggctattaacctcattctcgacgaactctggcataccaatgacaatcagatagccatctttaataggctcaaacttgtccccaagaaagtcgacctctcccagcagaaggagatccccaccaccctcgtggacgatttcatcctttccccagtcgtcaagagaagtttcatccagagcatcaaagtcatcaacgccataatcaagaaatacggcctccccaatgacatcataattgagcttgcaagagagaagaactccaaggatgcacagaagatgatcaatgagatgcaaaagaggaataggcaaacaaatgagaggatcgaggagatcatcaggacaacaggcaaggaaaacgccaaatacctcatcgagaagataaagctccacgatatgcaggaaggaaagtgcttgtacagcctcgaggccataccccttgaagacctcctcaacaaccccttcaactacgaggtcgaccatatcatccccagatctgtcagcttcgacaactccttcaacaacaaggtgctcgttaagcaagaggagaactcaaagaaggggaacaggacccccttccagtacctctccagcagcgattccaaaatctcctacgaaaccttcaagaaacatattctcaacctcgccaaaggcaagggaaggatatccaagaccaagaaggagtacctcctcgaggagagagatatcaacaggttctccgtccagaaagactttatcaacaggaatctcgtggataccaggtacgccaccaggggccttatgaacctcctcagatcctacttcagggtcaacaacttggacgtcaaggtcaagagcatcaacggcgggtttaccagcttcttgaggaggaaatggaagtttaagaaggagaggaacaaggggtacaagcaccacgccgaagacgccctcattatcgccaacgccgacttcatcttcaaagaatggaagaagctcgacaaggccaagaaagtcatggaaaatcagatgttcgaggaaaaacaggccgagagcatgcccgagatcgagaccgagcaggagtacaaggagatctttatcaccccccatcagatcaagcacatcaaggacttcaaggactacaagtactcccacagggttgataagaagcccaatagagaattgatcaatgacacactctacagcacaaggaaagacgacaagggtaacaccctcatcgtcaataacctcaatggcctctatgacaaagataacgataagttgaagaagctcatcaacaagtcccccgagaaactcctcatgtaccaccacgaccctcagacttatcaaaaacttaaattgatcatggaacaatatggtgacgagaagaaccccctctataaatattacgaggagaccgggaactacctcaccaagtatagcaagaaggacaatggacccgtcatcaagaagatcaagtactatgggaacaagctcaacgcccacctcgacatcaccgatgactaccctaacagtcgaaacaaggttgtcaagctctcccttaagccatacaggtttgacgtgtacctcgacaacggtgtttacaagttcgtgactgttaagaacctcgacgtcattaagaaggagaattattacgaggtgaacagcaaatgctacgaggaagccaaaaaactcaagaagatctccaaccaggccgagttcattgccagcttctacaataatgacctcatcaagataaacggggagctctacagggtgatcggtgtcaataacgacctcctcaacaggattgaggtgaacatgatcgacatcacctatagagagtacttggagaacatgaacgataagaggccccctaggatcataaagaccatcgccagcaagacccagagtattaagaaatacagcaccgacatcctcgggaatctctacgaggtcaagagcaaaaagcacccccagatcattaagaagggg

SEQ ID NO: 20 - DNA, 3159 bp, Artificial
  synthetic
atgaaaagaaactatatactcggcctcgacatcggcatcacctctgttgggtacgggatcatcgactacgagaccagggacgtcatcgacgcaggagtcaggcttttcaaggaagccaacgttgaaaacaacgagggaaggaggagcaagaggggggccaggagactcaaaaggaggaggaggcacaggatccagagggtcaagaagttgctcttcgattacaacctcctcacagaccacagtgaactctctgggatcaatccttacgaggcaagggttaaggggctcagccaaaaactctccgaggaggagtttagcgccgccctcctccacctcgccaagaggaggggcgtccacaacgtgaacgaggttgaggaggacaccggcaacgagctctccaccaaggagcagatttccagaaacagcaaggcactcgaggagaagtatgtggccgaattgcagttggagaggctcaagaaggacggggaggtgaggggctccatcaacaggttcaagaccagcgactacgtgaaagaggcaaagcaactcctcaaagttcagaaggcctaccaccaacttgaccagagcttcatcgatacctatatcgacctcctcgagacaaggaggacatactatgaaggccctggcgaggggagcccttttggctggaaagacatcaaagagtggtatgagatgctcatgggccactgcacctacttccccgaagaactcaggtccgtgaagtacgcctacaatgctgacctttacaacgccttgaacgacctcaataacctcgtcatcactagggacgagaacgagaaactcgagtattacgagaaattccagatcatcgagaacgtgtttaagcagaagaagaagcccacccttaaacagatcgccaaggaaatcctcgttaatgaggaggacatcaagggctatagggtgacctccaccggaaagcccgaattcactaacctcaaagtgtaccacgatatcaaggacatcaccgccagaaaagagataatcgagaatgccgagctcctcgatcaaatcgccaaaatactcaccatataccagtcctccgaggacatccaagaggagctcaccaacctcaactccgaactcacccaggaagaaatagagcagatctcaaaccttaaggggtataccggtacccacaacttgagcttgaaggccatcaacctcatcttggatgaactctggcatacaaacgacaaccagatagccatcttcaacaggttgaagctcgtgcccaagaaggtcgacctcagccaacagaaggagatacccacaaccctcgtggacgacttcatcctctcccccgtcgtgaagaggtccttcatccagagtatcaaggtgatcaacgctatcatcaagaagtatggcttgcctaatgacatcatcatcgagttggccagggagaagaatagcaaggacgcccagaaaatgatcaacgaaatgcaaaagagaaacaggcagaccaacgagagaatagaggagatcatcaggactactggtaaagagaacgccaagtatctcatcgagaagatcaagctccatgacatgcaggaggggaagtgcctctactccctcgaggccatccccctcgaggacctccttaacaaccccttcaactacgaggtcgatcacatcattcctaggtccgtgagcttcgacaacagtttcaataataaggtgctcgtgaagcaagaggagaattccaagaaggggaatagaactcctttccaatatctcagtagctccgactccaagatctcctacgagactttcaaaaagcacatcctcaacctcgccaaaggcaagggcaggatttccaaaaccaagaaggagtatctcctcgaggaaagagacattaacaggttcagcgtccagaaggactttataaacagaaacctcgtcgacaccaggtatgccactaggggccttatgaatctcctcagatcctacttcagagtgaacaaccttgatgttaaagttaagtccatcaatgggggattcaccagcttcctcagaaggaaatggaagttcaagaaggaaaggaacaaggggtacaaacaccacgccgaagatgcactcatcatagccaacgccgattttatattcaaagagtggaagaagctcgacaaggctaagaaagtcatggagaaccagatgttcgaggagaagcaggccgagtccatgcccgagatcgaaaccgagcaggagtacaaagaaatattcatcaccccccaccaaatcaagcacatcaaggactttaaggactataagtactcccatagggtcgataaaaagccaaacagggagctcatcaacgacaccctctatagtaccagaaaagacgacaagggaaacaccctcatcgtgaacaacctcaacggactctacgacaaggataacgataagctcaagaaactcattaacaagtcccccgaaaaactcctcatgtaccaccacgacccccaaacctaccagaagctcaaattgatcatggaacagtatggggacgagaagaaccctttgtacaaatactatgaggagaccggtaactatcttaccaagtacagcaagaaggacaacggccccgtcatcaagaagatcaagtactacgggaacaagttgaacgcacacctcgatatcaccgatgattaccccaactccagaaataaggtggttaagctcagcttgaagccctacagattcgacgtctacctcgataacggggtctacaagttcgtcaccgtgaagaatctcgacgtcatcaagaaggagaactactacgaggttaactcaaagtgctatgaggaggccaagaagctcaagaagatctccaaccaggccgagttcatcgcttccttctacaataatgacctcatcaagatcaatggggagctttacagggtcatcggcgttaacaatgacctcctcaacaggatcgaggtgaacatgatcgacatcacctacagggaatacctcgagaacatgaacgacaagagacctcctaggataatcaagacaatagcctcaaagacccagagcatcaagaagtactccaccgacatcctcgggaacctctacgaggtgaagagtaagaagcacccccagatcatcaagaagggc

SEQ ID NO: 21 - DNA, 3159 bp, Artificial
  synthetic
atgaagagaaactatatcctcgggctcgacatcgggatcacatccgtgggctatggtatcatcgactacgagaccagggacgttatagatgccggagtgaggctttttaaagaggccaacgttgagaacaacgagggaagaaggagcaaaaggggggccagaaggctcaagaggaggaggagacacaggatacagagggtgaagaagctcctcttcgattacaacctcctcactgatcactccgagctctccggaatcaatccctacgaggccagggttaaaggactcagccagaagttgtccgaggaggagtttagcgcagcactcttgcacctcgccaagaggagaggagtccacaacgttaatgaggttgaggaggacactggcaacgaactctccaccaaggagcagatctcaagaaacagcaaggccctcgaggagaagtacgttgccgagctccagttggagagactcaagaaggatggggaggtcaggggctccataaacaggttcaagaccagcgactatgtcaaggaggctaagcaactcctcaaggtgcaaaaggcctaccaccagctcgaccagagcttcatcgacacctatatcgacctcctcgagaccagaagaacctattacgaggggcctggcgagggctccccctttggatggaaggacatcaaggagtggtacgaaatgcttatgggccactgcacatatttccccgaagaactcagatccgtcaagtacgcctataacgccgatctctacaacgccctcaacgacctcaacaacctcgtgatcaccagggacgaaaatgagaaactcgaatactacgagaagttccagatcatcgagaatgtttttaagcagaaaaaaaagcccaccctcaagcagatcgccaaggagatccttgtcaatgaagaggacattaagggctacagggtgaccagcaccggtaaacccgaatttaccaacctcaaggtttaccacgacatcaaggacataaccgccagaaaagaaatcatcgagaacgccgagcttttggaccaaatcgccaagatcctcactatctatcaaagcagcgaggacatccaagaggagctcaccaacctcaacagcgagctcactcaggaggaaatcgagcagataagcaacctcaaggggtacactggaacccacaatctcagtctcaaggccatcaacctcatcctcgacgagctctggcacaccaacgacaaccagatcgccatttttaataggcttaagttggtgcccaagaaagttgacctctcccaacagaaggagatcccaaccaccctcgttgacgatttcatcctctcccccgtcgttaaaaggagctttatccagagcatcaaggtcatcaatgccattatcaaaaagtacgggcttcccaacgatatcatcatcgagctcgccagggaaaagaatagcaaagacgcccaaaaaatgatcaacgagatgcagaaaagaaataggcagaccaacgagaggatcgaggagatcatcaggaccaccggaaaggagaacgccaagtacctcatcgaaaaaatcaagctccatgacatgcaggagggcaagtgtctctattcactcgaggccatccccttggaggacctcctcaacaatccctttaactacgaagtcgaccacatcatccccaggtcagtgtccttcgacaactccttcaacaacaaggtgctcgttaagcaggaggagaacagcaagaaaggcaacaggacaccattccaataccttagttcttccgattccaagatctcctacgaaacctttaaaaagcatatcctcaacctcgccaaggggaagggtaggatctctaaaaccaagaaggagtacctcctcgaggaaagggacatcaacagattctctgtgcagaaggactttatcaacaggaatctcgtggacaccaggtacgcaaccaggggcctcatgaacctcctcaggtcctatttcagggtgaacaatctcgacgtcaaggttaagagcatcaacggggggtttacctcattccttaggaggaaatggaaattcaagaaggaaaggaataaggggtacaagcaccacgctgaggacgccctcatcatcgctaatgccgacttcatcttcaaagagtggaaaaagctcgacaaagctaagaaggtcatggaaaatcaaatgtttgaggagaagcaggccgagtctatgcccgagatcgagacagagcaggagtacaaggagatctttattaccccccaccagatcaagcacatcaaggatttcaaagattacaagtattcccacagagtggacaaaaaacccaacagggagctcatcaacgacacactctactccaccaggaaggatgacaagggaaacaccctcatcgttaacaaccttaacggcctttacgataaagacaacgataagctcaagaagctcatcaacaagtcccccgagaagctcctcatgtaccaccacgacccccagacttaccagaaactcaagctcatcatggagcagtacggcgacgaaaagaatcccctctataagtactatgaggagactggaaattacctcaccaagtactccaaaaaggacaacgggcctgtgatcaagaaaattaagtactatggcaacaagctcaacgcccacctcgacattaccgacgactaccccaacagcaggaacaaagtggtcaagctctctctcaagccttacaggtttgatgtctacctcgacaacggcgtgtacaagttcgtgaccgtgaaaaacctcgacgttatcaagaaggagaactactacgaggtgaattccaagtgttacgaagaagccaaaaagctcaagaagatctccaatcaggccgagttcatcgcaagcttctacaacaatgatctcatcaagataaacggagaactctacagagttatcggcgtcaacaatgatctccttaacagaattgaggtcaatatgatcgacatcacctacagggaataccttgagaatatgaacgacaagaggcccccaaggatcataaagaccatcgccagtaaaacccagtccattaaaaagtactcaaccgacatcctcggcaacttgtacgaggtgaaatctaagaagcacccccagatcatcaagaagggc

SEQ ID NO: 22 - DNA, 3159 bp, Artificial
  synthetic
atgaagaggaattatatcctcggactcgatatcggcatcacctctgtggggtacggaatcatagactacgaaacaagagatgtcatcgacgccggggtcaggcttttcaaagaagccaacgttgagaacaacgaggggaggaggagcaaaaggggggctaggaggctcaagaggaggaggaggcacaggattcaaagggtgaagaagttgctcttcgactacaacctcctcactgaccactccgagttgtccggcatcaatccttacgaggccagagtgaaaggccttagccaaaagctctccgaagaggagttcagcgctgccttgctccaccttgccaagaggagaggggtccacaacgttaacgaggttgaagaggataccgggaacgaactcagcaccaaggagcagatctccaggaacagcaaggccctcgaagagaagtacgtggccgagctccaactcgagaggctcaagaaggacggggaggttagagggagcatcaataggtttaagaccagcgactacgtgaaggaggccaaacagttgctcaaggtgcagaaggcctaccatcaactcgaccaaagctttatagacacctacatcgatctcctcgagacaagaaggacatactacgagggccccggagaggggtcccctttcggctggaaggacatcaaagagtggtacgagatgctcatgggccactgcacctacttccccgaggagctcaggtcagtcaagtatgcctacaacgctgacttgtacaatgccctcaacgaccttaacaatctcgtcatcaccagggacgaaaatgagaagcttgagtattacgagaaattccagattatcgagaatgttttcaagcaaaagaagaaacccaccctcaagcagatcgccaaggagatacttgttaatgaggaagacatcaagggctatagggtgaccagtaccggtaaaccagaattcactaatttgaaagtttaccacgacatcaaggacatcacagccaggaaagagattatcgagaatgccgagctcctcgatcagatcgcaaagatcttgacaatatatcagtccagtgaggacatccaggaagagctcaccaacctcaacagcgagctcacccaagaggaaatcgaacagatcagcaacctcaagggctacaccggaacccataacctctcactcaaagccattaacctcatcctcgacgagctctggcataccaatgataaccagatagccatattcaacaggcttaaactcgtccccaagaaggtggacctcagccaacaaaaggagatccccactacccttgtcgacgacttcatcctcagtcccgtggttaaaagatccttcatccagtccatcaaggtgatcaacgctatcataaagaagtatgggctccccaatgacatcatcatcgaacttgccagggagaagaacagtaaggacgcccagaagatgatcaacgaaatgcagaaaaggaacaggcagaccaacgagagaatcgaagagatcatcaggaccaccgggaaggaaaatgccaagtatctcatcgagaagatcaagctccacgacatgcaagaaggcaagtgcctctatagcctcgaggctatcccactcgaggatctcctcaacaaccccttcaactatgaagtcgaccatatcatccccaggtccgtctcctttgacaacagcttcaataacaaggtgctcgtgaaacaggaggaaaatagcaagaagggtaacaggacccccttccagtacttgtcctcctccgactccaagatcagctacgaaaccttcaagaagcacatccttaacctcgctaagggaaaaggcagaatcagcaagaccaagaaggagtatctcctcgaggagagggacatcaacaggttcagcgtccagaaagacttcatcaacaggaacctcgtcgacaccaggtatgcaactagggggttgatgaacctcctcaggagctacttcagagtcaacaacctcgacgttaaggtcaagagtataaatggtggcttcaccagtttcctcaggaggaagtggaagtttaagaaggagaggaacaaaggatacaagcaccacgccgaggatgccctcattatcgcaaacgccgactttatcttcaaggagtggaagaaactcgataaggccaaaaaagttatggagaaccagatgttcgaggagaagcaggccgaaagtatgcctgagatagagaccgagcaggaatataaagagattttcatcactcctcaccagataaagcatatcaaggacttcaaggactacaagtattcccacagagttgacaagaagcccaacagggagcttatcaacgacaccctctactccaccaggaaggacgacaagggaaacacactcatcgttaataacttgaatggactctacgacaaggacaatgacaaactcaagaagctcatcaataagagccccgagaagctccttatgtaccaccatgacccacagacatatcaaaagttgaagctcatcatggagcagtacggggacgaaaagaaccctctctacaagtactacgaggagactgggaactacctcaccaagtattccaagaaagataatgggcccgtcatcaagaaaataaagtactacggtaacaagctcaatgcccacctcgacatcaccgatgactaccctaacagcaggaacaaagtcgttaagctctcccttaaaccctatagattcgatgtctacctcgacaatggagtgtacaaatttgtcaccgtgaagaacctcgatgttatcaagaaagaaaactactatgaggtgaacagcaagtgctatgaggaggccaagaagcttaaaaagatcagcaaccaggccgaattcatcgcctccttttacaataacgacctcatcaagatcaacggagagctctacagagtgataggtgtgaataatgacctcctcaacagaatcgaggtcaacatgatcgacattacctacagggagtacctcgaaaatatgaacgacaaaaggccccccaggatcatcaagaccatcgcatccaagacccagtccatcaaaaaatactcaaccgacatccttgggaacctctacgaggtcaagagcaagaaacatccccagatcatcaagaagggg

SEQ ID NO: 23 - DNA, 3159 bp, Artificial
  synthetic
atgaagaggaactatatcctcggccttgatatcggcataacctccgtggggtatggcatcatagactacgagaccagagacgtcatcgacgccggcgttagactctttaaggaggccaacgtcgagaacaacgaggggagaaggagcaagaggggggccaggaggctcaagagaagaagaaggcacaggatccagagggtgaagaagttgctcttcgactataatctcctcaccgaccacagcgagctcagcgggatcaacccctacgaggccagggtcaagggtttgtcccagaagctcagcgaagaggagttttctgctgctctcctccacctcgccaagaggagaggcgtccacaacgtcaacgaagtggaggaggacaccggcaacgagctttccaccaaggagcagattagcagaaacagtaaagctcttgaggaaaagtacgtcgccgagctccagctcgagaggttgaagaaggacggcgaagtgagaggttccataaatagatttaagacctccgactacgttaaagaggccaagcagcttttgaaagtgcagaaggcctaccaccaactcgaccagtcattcatcgacacatacatcgaccttctcgagaccaggcgaacctattacgaaggccccggcgagggcagcccctttggatggaaggacatcaaggagtggtacgagatgctcatggggcactgtacttattttcccgaagagctcaggtcagtgaagtacgcctataacgccgacctctacaacgccttgaacgacctcaacaacctcgtcataaccagggatgagaatgaaaagctcgagtattacgaaaagttccagatcattgaaaacgtgttcaaacaaaagaagaagcccaccctcaagcaaatcgccaaagagatcctcgtgaacgaagaggatatcaaggggtacagggtgacctccaccggaaagccagagttcaccaaccttaaggtttaccacgatatcaaggacataaccgcaagaaaagaaatcatcgaaaatgcagagctccttgaccagatcgccaagatcttgaccatctaccaaagctccgaggacatccaagaggagctcaccaacttgaactcagaactcacccaagaggagatagaacaaatcagcaacctcaaaggctataccggtacccacaacctcagcctcaaggccatcaacctcatcctcgacgaactctggcataccaacgataaccagatcgcaatctttaataggctcaagctcgttcccaagaaggtcgatctcagccagcaaaaagagatccccactaccctcgttgatgacttcatcctctcccctgtggtcaagaggagctttatccagtcaatcaaggtgatcaatgccatcatcaagaagtacgggttgcccaacgatatcatcatagagctcgcaagggagaagaactccaaggacgctcagaagatgatcaatgagatgcagaagaggaacaggcagaccaacgagcgaatcgaggagatcataaggaccaccggcaaggagaacgctaagtacctcatcgaaaagataaaactccacgacatgcaggaaggtaagtgcttgtacagtttggaggccatacccctcgaagacctcctcaacaaccccttcaactacgaggtggaccatatcatccccaggagcgtcagctttgacaacagcttcaacaataaggtcttggtgaagcaggaggaaaactccaaaaagggcaacagaacaccatttcagtacctctctagctccgacagcaagatttcctacgagacttttaagaagcacatcctcaacctcgctaaagggaaagggagaatcagcaaaaccaaaaaggagtatttgctcgaggagagagatatcaacagattcagcgttcagaaagacttcatcaacaggaacttggttgacaccaggtatgccacaaggggcttgatgaacctcctcaggagctatttcagagtgaacaatttggacgtgaaggtcaagagcattaacggggggttcacctctttcctcaggagaaagtggaagttcaaaaaggagagaaacaaggggtacaagcaccacgccgaggacgccctcataattgccaacgcagatttcatcttcaaggagtggaaaaagctcgataaggcaaagaaggtcatggaaaaccaaatgtttgaggagaagcaggccgagtctatgcccgaaatcgagactgaacaggagtacaaggaaatcttcataaccccacaccagatcaagcacatcaaggacttcaaggattacaagtactcccatagggtggacaagaagcccaatagagagcttatcaatgataccctctactccactaggaaggacgacaagggcaacacacttatcgttaacaacctcaacgggttgtatgacaaagacaatgacaagttgaagaagttgatcaacaaaagccctgaaaagctcctcatgtaccaccacgaccctcaaacctaccaaaagctcaagctcataatggaacagtacggggacgagaagaaccccctctataagtactacgaagagaccgggaattacctcaccaagtattccaagaaggacaatggccctgttatcaagaagatcaagtactacggaaacaagctcaacgcccacctcgacatcactgatgactacccaaacagcagaaacaaggttgtgaagctctccctcaaaccctacaggttcgacgtctacctcgataacggcgtttataagtttgttaccgtcaaaaacctcgacgttatcaagaaagagaactactatgaggttaatagcaagtgctacgaggaggccaagaagcttaaaaagatctccaatcaggccgagtttatcgcaagcttttataataacgacctcatcaagatcaacggcgaactctacagggtcatcggggtgaacaacgatctcctcaacagaatcgaagtgaatatgatagatattacatacagggagtatttggagaacatgaacgataagaggccacccagaatcataaagaccatcgccagcaagacccagagcatcaagaaatacagtaccgacatcttggggaacctctatgaggtgaaaagcaagaagcacccccagatcatcaaaaaggga

SEQ ID NO: 24 - DNA, 3159 bp, Artificial
  synthetic
atgaaaaggaactatatcctcgggctcgacatcgggatcaccagcgttggctacggcatcattgattatgaaacaagggacgtgatcgatgctggggttaggctcttcaaggaagctaacgtcgagaataatgaggggaggaggtccaagaggggcgccaggaggctcaagaggaggaggaggcacaggatccaaagagttaagaagttgctcttcgactacaacctcctcaccgaccatagcgagctcagcggcattaacccctacgaagccagagtgaaggggctcagccagaagctcagcgaggaagagttctctgccgcactcctccatcttgcaaagaggagaggcgtccacaacgtcaatgaagttgaagaggacactggaaatgagctctccaccaaggagcagatcagtaggaacagcaaggcccttgaggagaagtatgtggccgagcttcagctcgaaaggcttaaaaaagacggagaggtgaggggctccatcaacaggtttaagaccagcgactacgtgaaggaggcaaagcaactcctcaaggtgcagaaagcttaccatcagctcgaccaatccttcatcgacacctacatcgacctcctcgagaccaggagaacttactacgaagggcctggggaggggagccccttcgggtggaaggacatcaaggagtggtacgaaatgctcatggggcactgtacctacttccccgaggagctcaggtctgtcaaatacgcctacaacgccgacctctacaatgcccttaacgatcttaacaacctcgtcatcaccagggacgaaaacgagaaactcgaatattacgagaagttccaaatcatcgaaaacgtctttaaacagaagaagaagcccaccctcaagcagattgccaaagaaatcctcgttaacgaagaggacatcaaaggttacagggtgacctccactgggaagcccgagttcaccaatctcaaggtgtaccacgacatcaaggatattacagcaagaaaggagatcatcgagaatgccgagctcctcgaccagatcgctaagatcctcaccatctaccagtcttccgaagatatccaagaggaacttaccaacctcaacagcgagctcacccaagaggagatcgagcagatcagcaacttgaagggttacaccggcacccacaacctctctctcaaggccataaacttgatcctcgacgagttgtggcacaccaacgacaatcagatcgctatcttcaataggctcaagctcgtccccaaaaaggtcgacctctcccagcagaaagagatccccaccactttggttgacgacttcatcctttcccccgtggtcaaaaggagcttcatccagagcatcaaggtcatcaatgcaatcattaagaaatacgggttgcccaatgacatcatcatagagctcgccagggagaagaactccaaggacgcccaaaaaatgatcaacgagatgcagaagaggaacaggcagaccaatgagagaatcgaagaaatcattaggaccaccggcaaggagaacgccaagtacctcatcgaaaagatcaagctccacgacatgcaagagggcaaatgcctctacagcctcgaggccatcccccttgaggatctcttgaacaacccattcaattatgaggtcgaccacatcattcccaggagcgtcagcttcgacaactccttcaacaacaaggtgttggtgaaacaagaggagaacagcaagaagggtaacagaacccctttccagtacttgagcagcagcgatagcaaaatctcttacgaaaccttcaaaaagcacatcctcaacctcgccaagggcaaaggcaggatttccaagaccaagaaggagtacttgctcgaggaaagggacatcaacaggttctccgttcagaaggacttcatcaacaggaacctcgtggacacaaggtacgccaccaggggcctcatgaacctcttgaggagctacttcagggtcaataacctcgacgtcaaggtgaaatctatcaacggggggttcacctcattcctcaggaggaagtggaagttcaagaaggagagaaacaagggatacaaacaccacgccgaggacgccctcatcatcgccaatgccgatttcattttcaaagagtggaagaagctcgacaaggcaaagaaggtcatggaaaaccagatgtttgaggagaagcaggccgaatccatgcccgagatagagaccgaacaggagtacaaggagatcttcatcaccccccaccagatcaagcacatcaaggacttcaaagactacaagtacagccacagagtggacaagaagcccaacagggagctcatcaatgacactctctacagcactaggaaggacgataaggggaacaccctcatcgtcaacaacctcaatggtttgtatgataaggacaacgacaaactcaagaaactcatcaataagagccccgaaaaactcctcatgtatcaccacgacccccagacctaccagaagttgaagctcatcatggagcagtacggggacgagaaaaatcccttgtacaagtattacgaggagaccgggaactacctcaccaagtactccaaaaaggacaacggtcccgttatcaagaagatcaagtactacgggaacaagctcaatgcacatctcgacataaccgacgactaccccaactccaggaacaaagtggtcaagttgtccttgaagccctacaggttcgatgtgtacttggataacggcgtgtacaaattcgttaccgtgaagaacttggacgtgatcaagaaggagaactactacgaggttaactccaagtgctatgaggaggctaaaaagctcaagaaaatcagcaaccaggccgagttcatcgccagcttttacaacaacgacttgatcaagatcaacggcgagctctacagggttataggcgtgaacaatgacttgctcaacaggatcgaggtcaacatgatcgacatcacttacagggagtacctcgagaatatgaacgacaagaggccacctaggatcatcaaaaccatcgctagcaagacccagagcatcaagaagtacagcaccgacatcttgggtaatctttacgaggttaagagtaaaaagcatccccagatcatcaaaaaggga

SEQ ID NO: 25 - protein, 1300 aa, Francisella tularensis subsp. novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 26 - DNA, 3900 bp, Artificial
  synthetic
atgagcatctatcaggaatttgtgaataagtattctctatcaaagaccctgcgtttcgaactcattcctcaaggcaaaaccttggaaaacattaaggccagagggcttatcttggatgacgagaaaagggccaaagattacaagaaggcaaaacaaataattgacaaatatcatcaattcttcatcgaagaaattttgagtagtgtttgtatcagcgaagatcttcttcagaattattcggatgtctatttcaagctcaaaaaaagcgacgacgataatttgcagaaggatttcaaaagtgcaaaggacactattaaaaagcaaatttctgaatatatcaaagattcagagaagttcaagaacctttttaaccagaatcttattgacgctaagaaggggcaagagtccgatcttatactatggctaaaacaaagcaaggataacggtattgaactcttcaaagcaaattccgatatcactgatattgacgaagcacttgagattatcaaatcttttaaaggttggactacatacttcaaggggttccacgaaaatcgaaagaatgtctattcaagtaacgatattcccacaagtataatttataggatcgttgatgacaatttacccaagttccttgagaataaggcaaagtacgaatccttgaaggataaggctcctgaagcaataaattatgagcaaataaaaaaggacctcgccgaagagcttacctttgacattgattacaaaaccagcgaagtcaatcaaagagttttttcattggacgaggttttcgagattgccaattttaacaattacttgaaccagtctggcattacaaagttcaacacaattatcgggggaaagtttgttaatggtgagaatactaaaaggaagggcataaatgagtatataaacctttattcccaacagataaatgataagactttgaagaagtataaaatgtcagttctcttcaaacagattctgtccgataccgaatcgaaatcttttgttattgataaattggaggacgacagcgacgtcgtgactacaatgcagagcttttatgaacaaatagctgcttttaagaccgtagaggagaagagcattaaagaaactctgtcgttgctgttcgacgacctaaaagctcaaaaacttgacctttcaaagatctacttcaagaatgataagtctctgaccgatttgtcacaacaagtttttgatgactatagtgtaattgggactgccgttctagagtacattacccagcagattgctcctaagaatttggataatccctctaaaaaggaacaggagttaatagctaagaaaactgagaaggccaaataccttagtttggagacaattaaattagccttagaagagtttaacaagcaccgtgatattgacaaacaatgtagattcgaagaaattctggcaaattttgccgctattcctatgatttttgacgaaattgcacaaaacaaggataatctggcacagataagcataaagtaccaaaaccagggtaagaaggatttattgcaggctagtgcagaagacgatgtgaaggcaataaaagacttattggatcagactaataacctgctgcataagctaaaaatcttccacatcagccaaagcgaggataaagctaatattctagacaaagatgagcatttttatttggtcttcgaagaatgctattttgaacttgcaaatattgttcctctttataacaagatccgtaactacataacacaaaaaccttattccgatgaaaagtttaagttgaacttcgagaattctactttggccaacggctgggacaaaaacaaagaacccgataatactgctattttgttcattaaggacgataagtattaccttggggttatgaataagaaaaacaataagatcttcgatgataaagcaatcaaggagaacaagggagagggttataagaaaatcgtctataaattgcttcctggggcaaacaagatgctacctaaggtgttcttcagcgcaaagtccattaagttttataacccttccgaggatatattaaggattcgcaatcattctacgcatacgaaaaatggtagcccacaaaagggatacgaaaaatttgaatttaatattgaagactgcaggaagttcatcgacttttacaaacaaagtatctctaaacaccccgagtggaaggactttggctttcgcttctcagatactcagagatataactcaatagatgaattctatcgtgaagtagagaaccaggggtacaaactaactttcgagaatattagcgagagctacatagattcagtagttaatcaaggtaagttgtatctgtttcaaatctataataaagacttctcagcatactctaagggtcgacccaacttgcataccttgtactggaaggccttgttcgatgaaaggaacctccaagatgtagtttacaagctgaatggtgaggccgagctgttctatagaaagcaatctattccgaaaaagatcacacatcccgctaaagaagcaattgctaataaaaacaaggataatcctaaaaaggagtctgtttttgagtatgatttaattaaggataaaaggtttaccgaggataagtttttcttccattgtcccataactatcaattttaagagttctggtgcgaataagtttaacgacgaaattaatcttttgcttaaggagaaggcaaacgatgtgcacatcttgagtatcgacaggggggagagacatctcgcatattacacattagttgatggcaagggaaacattatcaaacaggatacttttaatattataggtaacgatcgtatgaagacaaactatcacgataagttggctgcaatcgaaaaagatagggactctgcccgcaaggactggaagaaaattaacaatattaaagaaatgaaggaagggtatctgtctcaggttgttcacgagatcgcgaagcttgtaatagaatacaacgctattgtggttttcgaagatctgaacttcggtttcaaacgcggaaggtttaaggttgagaagcaggtttatcaaaagttggaaaaaatgttgattgaaaaattgaactatcttgtgtttaaagataacgaatttgataaaaccggtggcgttctccgtgcatatcaactcactgcaccatttgaaacatttaaaaaaatgggaaagcagacagggattatctattatgttccagcaggctttacttctaaaatatgtcccgtcaccggctttgtgaaccaattgtaccctaaatatgagtccgtttcaaaaagtcaggagttcttttcaaaatttgataaaatttgttataacttagataaaggttacttcgaattttcgttcgattataaaaactttggagataaagccgcgaagggaaaatggactatagcctcatttgggtcaagattaataaacttcaggaattctgataagaaccataactgggacaccagggaggtgtacccaacaaaagagctggaaaagcttcttaaggattactcaatagagtatggacacggcgaatgtataaaggctgccatttgcggcgaatcggataagaaatttttcgctaaattgacaagcgtgctaaacactatccttcaaatgagaaactcaaagacaggtactgaacttgactaccttatcagtcctgtggcggatgttaatggtaattttttcgactctcgtcaggcaccaaaaaatatgccccaagatgcagatgcaaatggtgcctatcacattggactcaaaggattaatgctgttgggaaggattaagaataaccaagagggaaagaaattgaacctcgtgataaagaacgaggaatatttcgaattcgtccagaacagaaataac

SEQ ID NO: 27 - DNA, 3900 bp, Artificial
  synthetic
atgtccatatatcaggagttcgtgaacaagtacagtcttagcaagaccttgaggtttgagcttatcccccagggaaagaccctcgagaacatcaaggccaggggcctcatcctcgacgacgagaagagggccaaggactacaagaaggccaagcagattatcgacaagtaccatcaatttttcatcgaggagatactctccagtgtttgcataagcgaggacctcctccagaattactccgacgtttatttcaagctcaagaagagcgacgacgacaatctccagaaagacttcaagtccgccaaggacaccatcaagaagcaaatcagcgagtatatcaaggattccgagaagttcaagaacctcttcaatcaaaacttgatcgatgccaagaagggccaggaaagcgacctcattctctggctcaagcagtccaaggataacgggattgagctcttcaaggccaacagcgacatcactgacattgacgaagccctcgagatcattaagtcatttaagggttggaccacctacttcaagggcttccatgagaacaggaaaaacgtgtactcatccaacgacatccccacctccatcatctacaggatcgtggacgacaatctccccaaattcctcgagaataaagccaaatatgagagcttgaaggacaaagcccccgaggccattaactacgagcagatcaagaaggatttggccgaagaacttacctttgacatcgactacaagacctccgaagtgaaccaaagggtcttcagcctcgatgaagtgtttgaaatcgccaatttcaataactacctcaaccaaagtgggatcacaaagttcaataccatcatcggaggcaagttcgttaacggcgaaaataccaagaggaagggaatcaatgagtacatcaacctctactcacaacagattaacgataagaccctcaaaaagtacaaaatgagcgtcctctttaagcaaatcctcagcgacaccgagagcaagtcattcgtgattgacaagttggaggacgactccgacgtggtgacaactatgcagtccttctacgagcagatcgccgcctttaaaaccgtggaggagaagagcatcaaagagaccctcagcttgctctttgacgacttgaaggcccagaaactcgacctttctaagatctatttcaagaatgacaagtccctcaccgacctcagccagcaagtgttcgacgactactcagttatcgggacagcagtcctcgaatacattacacagcagatcgccccaaagaacctcgataacccctccaagaaggagcaggagctcatcgccaagaaaaccgagaaggctaagtatctcagtttggagactatcaagctcgccctcgaggagttcaacaagcacagagacatagacaagcaatgtaggtttgaggagatcttggccaacttcgccgccatccccatgatattcgacgagatcgcccagaacaaagacaacctcgcccagatcagcatcaagtatcagaatcaggggaagaaggatctccttcaggcctcagccgaagatgacgtcaaggccatcaaggatctcctcgaccaaacaaacaacctcctccacaaactcaaaattttccatatcagccagtccgaagacaaggccaacatcttggacaaggacgagcatttctacctcgtctttgaagaatgctacttcgagctcgccaatatcgtgccactctacaataaaatcaggaactacatcacccagaaaccatacagtgacgagaagttcaaacttaatttcgagaactccaccctcgctaacgggtgggataagaacaaggagcccgacaacaccgcaattcttttcatcaaggacgacaagtactacctcggcgtcatgaacaaaaagaacaacaaaatcttcgatgataaagccatcaaggagaacaagggcgaggggtataagaagatagtgtataagcttctccccggcgccaacaagatgctcccaaaagtcttttttagcgccaagtccataaagttctacaaccccagtgaggatatcctcaggatcaggaaccactccactcacacaaagaacgggagcccccaaaaagggtacgagaaattcgaattcaacatcgaagactgcagaaagttcatcgatttctacaagcagtccatctccaaacaccccgaatggaaggatttcgggttcaggttctcggacacccaaaggtacaacagcatcgacgaattctacagggaggttgagaaccagggttacaaattgacattcgaaaacatcagtgagagctatatcgattccgtggtgaaccaggggaagctctacctctttcaaatatataataaggatttcagtgcctacagcaaggggaggccaaacttgcataccctttactggaaagcactcttcgacgagaggaacctccaggacgtggtttataagttaaacggcgaggccgagctcttctacaggaaacagagtatccccaaaaagatcacacaccccgccaaagaggccatagccaacaagaacaaggacaaccccaagaaagaatccgttttcgagtatgacctcatcaaggacaagaggttcaccgaggacaaattcttctttcactgccctatcaccattaactttaagtcctccggcgccaacaagttcaacgacgagatcaacctcttgcttaaggagaaggctaatgacgttcacatactcagcatcgacaggggggagaggcatctcgcctactacaccctcgtggacggcaaaggcaacatcatcaagcaagacaccttcaacattatcgggaacgacaggatgaagaccaactaccacgacaagctcgccgctatcgagaaagacagggacagcgccagaaaagactggaagaaaataaacaatatcaaggagatgaaagaagggtacctcagccaagtcgtccatgagatcgccaagctcgtgatcgagtataacgctatagttgtcttcgaggacctcaacttcggcttcaaaagaggcaggttcaaagtggaaaagcaggtgtaccagaaactcgaaaagatgctcatcgagaagttgaactatctcgttttcaaggataatgagttcgacaaaaccgggggcgtcctcagggcctaccagctcaccgcacccttcgagactttcaaaaaaatgggcaagcagaccggtatcatttactatgtccccgccggtttcacttctaagatctgccccgtgacaggctttgtgaaccagctttatcccaagtacgaatcagtttccaagtcccaggagttcttctctaagtttgataagatatgctacaacctcgacaaggggtatttcgaattcagcttcgattataagaacttcggagacaaggccgccaagggaaagtggaccatcgccagctttggttccaggctcataaacttcaggaacagcgacaagaaccacaactgggataccagggaggtttaccctaccaaagaactcgagaagctcctcaaggactactccatcgagtacggtcatggggagtgcatcaaggctgccatctgcggcgagagcgataagaagttcttcgccaaactcaccagcgttttgaacaccatcctccagatgaggaatagcaagaccggcaccgagctcgactacctcatctcacccgtcgccgacgtgaacggcaatttcttcgattctaggcaggcacctaagaacatgccccaggacgcagacgccaacggcgcctaccacatcgggcttaaggggctcatgctcttgggcagaatcaaaaacaaccaagaggggaaaaaactcaacttggtgatcaagaacgaggaatacttcgagttcgtccagaacaggaacaac

SEQ ID NO: 28 - DNA, 3900 bp, Artificial
  synthetic
atgagcatataccaagagttcgtgaacaagtacagcctctctaagacccttaggtttgagctcatcccccaggggaaaaccctcgagaacatcaaggccaggggcctcatcctcgacgatgagaagagggccaaggactacaagaaagccaagcagatcatcgacaagtatcaccagttcttcatcgaagagatcctctcctccgtgtgcatcagtgaggacttgctccaaaattactccgatgtgtacttcaagctcaagaagtcagatgatgacaaccttcagaaggactttaagagtgccaaagataccatcaaaaaacagatcagcgagtacatcaaggactccgagaagttcaagaacttgttcaaccagaacctcattgacgccaagaaggggcaggagtccgatctcatcctctggctcaagcagagcaaagacaacgggatcgagctcttcaaggctaactcagacataaccgacatcgatgaggccctcgagatcatcaaatcctttaaggggtggaccacttattttaaggggtttcacgagaacaggaagaatgtctatagcagcaacgacatccccaccagcatcatctataggatcgtggatgataatcttcccaaatttttggaaaacaaggccaagtacgaatctctcaaggacaaggcccccgaggccattaactacgaacagatcaagaaggacctcgccgaggaacttaccttcgacattgattacaagacctccgaggtgaaccagagggtgttcagcctcgacgaggtgtttgagatcgcaaacttcaataactacctcaaccaaagcggtatcaccaagttcaacaccatcattggggggaagttcgtcaacggtgagaacactaaaaggaaagggatcaacgaatatatcaatctctactctcagcagatcaatgacaagaccctcaaaaagtacaagatgagcgttctcttcaaacagatcctctccgataccgagtccaagagtttcgtgatcgataagctcgaagacgacagtgatgtggtgaccaccatgcagagcttttacgaacagatcgccgctttcaaaaccgtggaggaaaaatccatcaaagagaccctttccctcctcttcgacgacctcaaggcccaaaagcttgacctcagcaagatttacttcaaaaacgacaagagcctcaccgacctcagccagcaggttttcgacgactactccgttattggcaccgccgtgttggagtacatcacccagcagatcgccccaaaaaacctcgacaacccctccaagaaggagcaggaactcatcgccaagaagacagaaaaggccaaatacctttcacttgagacaatcaagctcgccctcgaggagttcaacaagcacagggatatcgacaagcaatgtaggttcgaagagatcctcgcaaacttcgccgccatccccatgatctttgacgaaatcgcacagaacaaggacaatctcgcccagatcagcatcaagtaccagaaccagggcaaaaaggatctcttgcaggctagcgctgaggacgatgttaaggccatcaaagacctcttggatcagaccaacaaccttctccacaagctcaagatcttccacatctcccagtccgaagacaaggccaacatcttggacaaggatgagcatttttacctcgtgttcgaagaatgctacttcgagctcgctaacatcgtccccttgtacaacaagatcagaaactatattacccagaagccctactccgacgaaaagtttaagctcaactttgagaattcaacattggcaaacggctgggataagaacaaggagccagacaataccgccatcctctttatcaaggatgataagtactacctcggagtcatgaataagaagaataacaagatattcgacgacaaagccatcaaggagaacaagggggagggctacaagaagatcgtgtataagctcctccccggcgccaacaagatgttgcccaaggtgttcttcagcgctaaaagcatcaagttttataaccccagtgaagatattctcaggataaggaatcacagcacacacaccaagaacgggagcccccagaaagggtacgaaaagttcgagttcaatattgaggactgtaggaagtttatagacttctataagcagagcatctccaagcaccccgagtggaaagactttggattcaggttctccgacacccagaggtataactcaatcgacgagttctacagggaggttgagaatcaaggttacaagctcacctttgagaacatctccgagtcctacatcgactctgtcgtgaaccaggggaagctctatctcttccagatctacaacaaggacttcagcgcatacagcaagggtaggcctaatctccacaccctttactggaaagccctcttcgacgagaggaaccttcaggacgtggtttataaactcaacggtgaggccgagctcttttacaggaagcagtccatccccaaaaagattactcacccagccaaggaggccatcgccaataagaacaaggacaaccccaagaaggaatccgtctttgagtatgacctcataaaagataagaggtttaccgaggacaagttcttctttcactgtcccatcaccataaacttcaagtctagcggggccaacaagttcaacgacgagataaacctccttctcaaggagaaggcaaatgacgtgcacattctctccatcgacaggggcgagaggcatttggcctattacaccctcgtggatgggaagggcaacattattaagcaagacaccttcaacatcataggaaacgacaggatgaagaccaactatcacgacaaattggccgctatagagaaggacagagactcagccaggaaggattggaagaaaataaacaacatcaaggagatgaaggagggctacttgagccaggttgtccacgaaatagccaagttggtcattgaatacaacgccatagttgtcttcgaggatctcaactttggctttaagagggggaggttcaaggtggagaagcaggtgtaccagaagctcgagaaaatgctcatcgaaaagctcaattacttggtgttcaaggataatgagtttgacaagaccgggggcgtcctcagagcctaccagctcaccgccccattcgagaccttcaagaaaatggggaagcagaccgggatcatctactacgtgcccgccgggttcacctcaaagatatgccccgtgacaggcttcgtcaaccaattgtaccccaagtacgagtccgtctccaagtcccaggagttcttcagcaagtttgacaaaatttgctacaacctcgacaagggctacttcgagttctccttcgattacaagaattttggggacaaagccgccaaagggaagtggacaatagcaagcttcgggtcaaggctcatcaattttagaaactcagacaaaaaccacaactgggacactagggaggtgtatccaaccaaggagctcgagaagctcctcaaggactacagtatcgagtacggacacggcgaatgcatcaaggccgccatctgcggcgagtcagacaagaaattcttcgccaaactcactagcgtcctcaacacaatcctccagatgaggaactccaaaaccgggactgagctcgactacctcatcagcccagtcgccgacgttaacggcaatttcttcgattccaggcaggcccccaagaacatgccccaggacgccgacgccaatggggcctatcatatcgggctcaaagggctcatgttgctcggcaggatcaagaacaatcaggagggaaagaagttgaacctcgttatcaaaaacgaggagtacttcgagttcgttcagaataggaacaat

SEQ ID NO: 29 - DNA, 3900 bp, Artificial
  synthetic
atgtcaatctaccaagaattcgttaacaaatactccctcagcaaaacccttagattcgagctcatcccccagggcaaaacactcgagaacattaaggctagggggcttatcctcgacgacgaaaagagggccaaggactacaagaaagccaagcagataatcgacaaataccaccagttcttcatcgaggagatcctctcctccgtttgcatctccgaggacctccttcagaactacagtgatgtgtactttaagctcaaaaagtccgacgacgacaacctccagaaggatttcaagtccgccaaggacaccatcaagaagcagatatccgagtacattaaggacagcgagaaattcaagaacctcttcaatcagaacctcatcgacgcaaaaaaaggacaggagagcgacctcatcctttggctcaaacagtccaaagacaacggtatcgagctcttcaaggcaaactctgacatcaccgacatcgacgaagccttggagatcataaagagcttcaaggggtggaccacttactttaaagggttccacgagaacaggaagaacgtgtactcctcaaatgacatccccaccagcatcatctacagaatcgtggacgacaatctgcccaagtttttggaaaataaggccaaatatgaaagcctcaaagacaaggcacccgaggccataaactacgagcagatcaagaaggacctcgccgaagaactcaccttcgacattgactacaagactagcgaggttaatcagagagtctttagccttgacgaggtttttgagatcgccaacttcaataactacctcaatcaaagcggcataaccaagttcaataccatcatcggcggcaagttcgttaacggtgagaacaccaagaggaagggcatcaatgaatacattaatctctactcccagcaaatcaacgacaagactctcaaaaagtacaagatgtccgtcctttttaagcagatactcagcgataccgagtctaagagcttcgtcattgacaagctcgaggatgacagcgacgtggttaccaccatgcagagcttctacgagcagatcgccgccttcaagactgtggaagagaagagcattaaggagaccctcagtctcctcttcgacgacctcaaggcacagaagctcgatctcagcaagatatatttcaaaaatgacaagtccctcaccgacctcagtcaacaagttttcgacgactacagcgtcatcgggaccgccgtcttggagtacattacccagcagatcgcccccaaaaacctcgacaaccctagcaagaaagaacaagagctcatagccaagaagaccgaaaaggccaagtacctctccctcgaaaccattaagttggccctcgaggagtttaacaagcacagggacatcgacaagcagtgtagatttgaggaaatacttgccaacttcgccgccatccccatgatctttgacgagatcgctcagaataaggacaacctcgcacagatctcgataaagtaccagaaccagggtaaaaaagacttgttgcaggcctctgccgaggacgacgttaaggccatcaaagatttgctcgaccagactaacaacctccttcacaaactcaagatcttccacatctctcagagtgaagacaaggccaacatactcgacaaagacgagcacttctacctcgtgttcgaagaatgctacttcgagctcgccaacatcgttcccctctacaacaagatcaggaactacattacccagaagccctactcagatgaaaaattcaagctcaacttcgagaactccaccctcgccaacggctgggataaaaacaaggagcccgacaacaccgccatcctcttcataaaggacgataaatattacttgggagttatgaacaagaaaaacaacaagatcttcgacgataaggctataaaggagaacaaaggggaggggtacaaaaagatagtttacaagctcctccccggtgccaacaagatgctccccaaggtgttcttctccgccaagagtataaagttctacaaccccagcgaggacatcctcaggataaggaatcactccacccacaccaagaatggcagcccccagaaggggtatgaaaagttcgaattcaacatcgaggactgcaggaagttcatcgacttctacaaacagagcatcagtaagcacccagagtggaaggatttcgggtttaggttctccgatacccagaggtacaactccatcgacgagttctatagagaggttgagaaccaggggtacaagctcacctttgagaacatcagcgagtcctatatcgactccgtcgttaaccaggggaaactctacttgttccaaatttacaacaaggatttctccgcctactccaagggtaggcccaaccttcacaccctctactggaaggccctcttcgatgagagaaacctccaggacgttgtgtataagctcaatggggaggccgaactcttctacagaaagcaatccatccccaaaaagataacccatcccgctaaggaggctatcgccaataagaacaaggacaatcccaagaaggagtccgtgttcgagtacgatctcataaaggacaaaaggttcaccgaggacaagttcttcttccattgtccaattaccatcaattttaaaagctcaggagccaacaaatttaacgacgaaatcaacctcttgctcaaggagaaggccaatgacgttcacatcttgtccatcgacaggggcgagagacacttggcatactatactctcgttgatggcaagggcaatatcattaaacaagacaccttcaacatcatcgggaacgacagaatgaaaaccaactaccacgacaagctcgccgccatagagaaggacagagactccgccaggaaggactggaaaaagatcaacaacatcaaggagatgaaggaggggtacctttcccaggttgttcacgagatcgccaagctcgtgattgagtacaacgccatcgtggtgttcgaggacctcaactttggctttaagaggggcaggttcaaagtggagaagcaggtttatcagaaactcgagaagatgctcatcgagaaactcaactacttggtcttcaaggacaacgagttcgacaagactggtggggtcttgagggcctatcaactcacagcaccctttgagaccttcaagaagatggggaagcagaccggcatcatctattatgtgcctgccgggttcaccagcaagatctgccccgtgaccggcttcgttaaccagctctatcccaagtatgagtccgtcagcaagtctcaagagttcttttccaagttcgacaaaatctgctataacctcgacaaaggttacttcgagttcagcttcgactacaagaacttcggcgacaaggccgctaaggggaaatggaccattgcctctttcggcagcaggctcataaacttcaggaacagcgacaaaaaccacaactgggataccagagaggtttatcccacaaaggagctcgagaaactcctcaaggactactctatcgagtacggccacggcgaatgcatcaaggctgccatttgcggagagtctgacaagaaattcttcgccaagctcacctccgtcttgaacaccatcctccagatgagaaatagcaagaccgggactgaactcgactacctcatctcccctgtggccgacgtcaacggcaatttcttcgattcaaggcaggcacccaagaatatgccccaggatgccgacgccaatggggcctaccacatcggcctcaaggggttgatgttgcttgggaggatcaagaacaaccaggaaggcaagaagctcaacctcgtgatcaaaaatgaagagtacttcgaatttgtccaaaataggaacaat

SEQ ID NO: 30 - DNA, 3900 bp, Artificial
  synthetic
atgtccatctaccaggaattcgttaataaatacagcctcagcaagaccctcaggttcgagctcatcccccagggcaagaccctcgaaaatatcaaggccaggggactcatcctcgacgacgagaaaagggctaaagattacaagaaggccaagcagataattgacaagtaccaccagttcttcatcgaggagatcctcagttccgtctgtatcagtgaggatctcctccagaactactctgacgtctacttcaagctcaaaaagagcgacgatgacaatctccagaaggacttcaagagcgccaaggacacaataaagaaacaaatcagcgaatatatcaaggacagcgagaagtttaagaaccttttcaaccagaacctcattgacgccaagaagggccaagaatctgacctcatcttgtggctcaaacagtctaaggacaacggaatcgagttgttcaaagccaactccgacatcactgacatcgacgaggccctcgaaatcattaaatccttcaagggatggaccacctacttcaagggcttccatgagaacaggaagaacgtttacagcagcaacgatatacctaccagcatcatatataggatcgtggacgacaacctccccaagttcctcgagaacaaggctaagtacgagagccttaaggacaaagcccccgaagccatcaactacgagcagatcaagaaggacttggccgaggagctcactttcgacattgactataagaccagcgaagtcaaccaaagggtgttttcacttgacgaggtgtttgagatcgccaattttaacaactacctcaaccagagtgggatcaccaagtttaacaccatcatagggggcaagttcgtgaatggggagaacaccaagaggaaggggatcaacgaatacatcaacttgtacagtcagcagattaacgacaagactctcaagaagtataagatgtccgtcctttttaaacagattctctccgatacagagagcaagtcattcgtcattgacaaacttgaggacgactctgacgtcgtcaccactatgcagtccttctatgagcagattgcagcctttaagaccgttgaggagaagagcatcaaagagaccttgtccctccttttcgatgacctcaaagcccagaagctcgacctctccaagatatacttcaagaatgacaagtccctcacagacttgagccagcaagtgttcgacgactacagcgtcatcggcaccgccgtgctcgagtacatcacccaacagatcgcccccaagaacctcgacaaccccagtaagaaggagcaggagctcatcgccaagaagacagaaaaggccaaatatctcagtctcgagaccatcaagctcgcactcgaagagttcaacaagcacagggacatcgacaagcagtgcaggttcgaggagatcctcgccaacttcgctgctatccccatgatcttcgatgagatagcccagaacaaagacaatctcgctcagatctctatcaagtaccagaaccaaggaaagaaggacctcctccaggccagcgccgaggacgacgtcaaggccatcaaggacctcctcgaccagaccaacaatcttctccacaaactcaagatcttccacatctcccaatccgaagacaaggccaacatactcgacaaggacgaacacttctacctcgtttttgaggagtgctacttcgagctcgccaacatcgttcctctctacaataaaattaggaactacatcacccagaaaccctatagcgatgagaagtttaaattgaacttcgagaattccacactcgccaatgggtgggacaagaacaaggagcccgacaataccgccatcctcttcattaaggacgacaagtattaccttggagttatgaataaaaaaaacaataagattttcgacgacaaggccatcaaggagaacaaaggtgaaggctataagaagatagtgtacaagttgctcccaggcgcaaacaagatgcttcccaaggtgttcttttccgccaagtctatcaagttttacaatccctcagaagacatcctcaggatcaggaatcattccacccataccaagaatgggagccctcagaagggctacgagaagttcgagttcaatatcgaggactgcaggaagttcattgatttctacaaacagtcaatctccaagcaccccgaatggaaagatttcggcttcagatttagcgacactcagaggtacaattccatcgacgagttctacagggaggttgaaaatcagggatacaagctcaccttcgagaacatttccgagtcttacatcgatagcgtggtcaatcagggtaaactttacctcttccagatctacaacaaggacttctccgcctactccaaaggcagacccaacctccacaccctctactggaaagcactttttgacgagaggaaccttcaggacgttgtttacaagctcaacggggaggctgagctcttctacaggaagcaatccataccaaagaaaatcacacatcccgccaaggaagccatcgccaacaagaataaggataatcccaaaaaagaatccgtcttcgaatatgacctcataaaggataaaaggtttaccgaagacaaattctttttccattgccccatcaccatcaacttcaagtcatccggggcaaacaagttcaacgacgagattaacctcctcctcaaagagaaggccaatgacgtgcatatcttgtccatcgacaggggggagagacacctcgcctattacaccctcgtggatgggaagggtaacatcatcaaacaggacaccttcaatatcatcggcaacgacaggatgaaaaccaactaccacgacaagttggctgccatcgaaaaggacagagacagtgccaggaaggactggaagaagatcaacaatataaaggagatgaaggagggttatctcagccaggtggttcacgagattgccaagcttgtcatcgagtataacgccatcgtcgttttcgaggacctcaatttcgggttcaagaggggtaggttcaaggttgagaagcaggtttatcagaagctcgagaagatgctcattgagaagcttaattacctcgtgttcaaggacaacgagttcgacaagaccggcggcgtcctcagggcctaccagctcaccgcccccttcgagacattcaagaaaatgggtaagcagaccggcattatatactacgtccccgctgggttcaccagcaagatctgccctgttaccggctttgtcaatcagctttaccctaagtatgagtccgtgagcaagagccaggaatttttttccaagttcgacaagatctgttataacctcgacaagggctacttcgagttcagcttcgactacaaaaatttcggtgacaaggccgccaaggggaagtggaccatcgcaagcttcggttctaggctcatcaatttcaggaacagcgacaagaaccacaactgggatactagagaggtgtaccccaccaaggagctcgagaagctcctcaaggactatagcatcgagtatggtcacggtgagtgcatcaaagccgccatctgcggcgagtccgacaaaaagttttttgccaaattgacctccgttctcaacaccatcctccagatgaggaacagcaaaaccgggaccgagttggattacctcatcagccccgttgcagatgtgaacggcaacttctttgacagcaggcaggcccccaaaaatatgcctcaggatgctgacgcaaatggtgcctaccacatcgggctcaaggggctcatgctcctcgggagaatcaagaataaccaggagggcaagaagctcaacctcgtcatcaagaacgaggagtactttgaatttgtgcagaacaggaataac

SEQ ID NO: 31 - DNA, 3900 bp, Artificial
  synthetic
atgagtatctatcaggagttcgtgaataaatacagcctcagcaaaactctcaggttcgagctcatacctcaaggcaagaccctcgagaatatcaaggccaggggcctcatcctcgatgatgagaagagggccaaggactacaaaaaggccaagcagatcatagacaaataccatcagttctttatcgaggaaatactctccagcgtttgcatcagcgaagaccttctccagaactactctgatgtgtacttcaagctcaagaagagcgacgatgataacctccaaaaagacttcaagagtgccaaggacactatcaagaagcagatttcagagtacatcaaagatagcgagaaattcaagaacctcttcaatcaaaacctcatcgatgccaagaaaggccaggaatccgacctcattctctggctcaagcagagcaaagacaacggtattgaactcttcaaggctaacagcgacatcaccgacatcgacgaagccttggagataataaagagtttcaaaggctggacaacctacttcaagggcttccacgaaaacaggaagaatgtttactctagcaatgatatacccacctccatcatttacagaatcgttgacgacaatctccccaagttcctcgagaacaaggctaagtatgaatccctcaaggacaaggcccccgaagccatcaactacgagcagataaagaaagatttggctgaggagctcacctttgacatcgactacaagacctctgaagtgaaccagagagtgttcagcctcgacgaagtttttgaaatcgccaacttcaacaactatctcaaccagtccggtatcaccaagtttaacacaatcatcggaggtaagttcgtgaacggggagaacacaaagaggaaaggcattaacgagtatatcaacctctacagccagcagatcaatgataagacactcaaaaagtacaagatgagcgtcctctttaaacagatactcagcgacaccgaatctaaatccttcgtcattgacaagctcgaggacgactccgacgtcgtcaccacaatgcaatccttctacgagcagatcgccgccttcaagaccgtcgaggagaagtccatcaaggagaccctcagcctcctctttgatgacctcaaagcccaaaagctcgacctctccaagatctacttcaagaatgacaagagcctcaccgacctctcccaacaagtcttcgacgactattccgtcatcggcaccgccgtcctcgagtacatcacccaacaaatcgcccctaagaacctcgacaatcccagcaaaaaggaacaagaactcatcgccaagaagaccgaaaaggccaaatacctcagccttgaaactatcaagcttgccctcgaagagttcaacaagcacagggacatcgacaagcagtgcagatttgaagagatcctcgccaattttgccgccattcccatgatcttcgacgaaatcgcccagaataaggacaacttggctcagatcagtatcaagtaccaaaatcagggcaagaaggacctcctccaggccagtgctgaggatgacgtgaaggccatcaaggatctcctcgatcagaccaacaacttgctccataaactcaagatcttccatatcagccagagcgaggacaaggccaatatccttgataaggacgagcatttctacctcgttttcgaggagtgctacttcgagcttgctaatatcgtccccctctacaacaagatcagaaactacatcacccagaagccctattccgacgagaagttcaagctcaacttcgaaaactcaactctcgccaacggttgggataagaataaagagcccgacaacaccgccatcctcttcataaaagacgacaaatattatttgggcgttatgaacaagaagaacaacaagatctttgacgataaagccatcaaggagaataagggcgagggctacaaaaagatcgtttataagctcctcccaggtgccaataagatgcttcccaaggtttttttctccgccaagtccatcaagttctataacccctccgaggacatcctcaggataaggaatcactctacccataccaaaaacggctcaccccagaaagggtacgagaagttcgaattcaacatcgaggactgtaggaagttcatcgacttctacaagcagtccatcagtaagcaccctgagtggaaggatttcgggttcaggttcagcgatacccagaggtataacagtatcgatgagttctacagggaggtggaaaaccagggatacaagctcacatttgagaacatatccgaaagctacatcgactccgtggtgaaccaggggaagctctatctcttccagatctataataaggacttctctgcttactctaaggggagacccaatctccacaccctctactggaaggccctcttcgacgaaaggaacctccaagacgttgtctacaagctcaacggggaggccgagcttttctacagaaagcagtcaatccccaagaagattacccaccctgccaaggaggccatagccaacaagaataaggacaaccccaagaaggaaagcgttttcgaatacgatctcattaaggacaagagattcaccgaagacaagttctttttccactgccccatcaccatcaattttaagagctctggtgccaacaaattcaacgacgagatcaatctcctcctcaaggagaaggccaatgacgtgcacatcctcagcatcgacagaggggagaggcacctcgcctactataccctcgtggatgggaaaggaaacatcatcaagcaggatacttttaacatcatcgggaacgataggatgaagaccaactaccatgataagctcgccgcaatcgagaaggacagagactccgccagaaaggactggaagaagataaataacatcaaagagatgaaagagggctacttgtcccaagtcgtgcacgagatcgccaagctcgttatcgagtacaacgccatcgtcgtgttcgaggatctcaacttcgggttcaagagaggcaggttcaaggttgagaagcaggtctatcagaagcttgagaagatgctcattgaaaagctcaactacttggtctttaaggataacgagtttgataaaaccggaggcgttctcagggcctaccagctcaccgcccccttcgagaccttcaagaaaatggggaagcagaccggtatcatctactatgtgcccgccggcttcacctccaagatctgcccagttaccggcttcgttaaccagctctatcccaagtacgaatctgtgtccaagtcacaggagttcttcagtaagtttgacaaaatctgctacaacctcgataagggttacttcgagttcagcttcgactacaagaacttcggggacaaggccgccaaggggaagtggacaatcgccagtttcgggtccaggctcataaactttaggaactccgataaaaaccacaactgggacaccagggaagtctaccccaccaaagagttggagaagctcctcaaggactatagtatcgagtacggccacggtgagtgcattaaggccgccatctgtggagagtccgacaaaaagtttttcgccaagctcaccagcgttttgaacaccatactccagatgaggaacagcaaaaccggtaccgaactcgactacctcattagccccgtggccgatgtcaatgggaactttttcgacagcaggcaggcacccaagaacatgccccaggacgccgacgccaacggagcctaccacatcggcctcaaggggctcatgctccttggtagaatcaaaaacaaccaggagggcaagaagctcaacctcgtcatcaaaaacgaagagtacttcgagtttgtccagaacaggaacaat

SEQ ID NO: 32 - DNA, 3900 bp, Artificial
  synthetic
atgtctatctaccaggagttcgtcaacaagtactccctcagcaagaccctcaggtttgagcttatcccacaaggcaagaccctcgagaacatcaaggccaggggtcttatcctcgacgacgaaaaaagggccaaggactacaagaaggccaagcagatcatcgacaagtaccaccagttctttatcgaggagatactcagcagcgtgtgcatcagcgaggaccttctccagaactactccgacgtttactttaagctcaagaagtctgacgacgataacctccagaaggacttcaagtccgccaaggataccatcaagaagcagatcagcgagtatattaaggatagcgagaagttcaagaatcttttcaaccagaacctcatcgatgccaaaaaggggcaggaaagtgacctcatactctggctcaaacagagcaaagacaacgggatcgagctcttcaaagccaacagcgacatcacagacatcgacgaggctctcgaaatcatcaaaagttttaagggatggaccacctacttcaagggtttccacgagaataggaagaatgtgtactcttcaaatgacattcccacctccatcatctataggatcgtggatgataacctccccaagttcctcgagaataaggccaagtatgagtccctcaaggacaaggcccccgaggccataaactacgaacagatcaagaaggatctcgccgaggaattgacattcgatatcgactacaagactagcgaggtgaaccagagggtgttcagcctcgacgaagtgttcgaaatcgccaatttcaacaactatctcaaccagagtgggataaccaaatttaatacaataataggcggcaagttcgttaatggcgagaacaccaagagaaagggcatcaatgagtatatcaatctctatagccagcagataaacgacaagaccctcaaaaaatacaagatgtccgtcctctttaagcagatcctctccgacaccgaatcaaagtcctttgtcatcgacaagttggaggacgactccgacgttgtcaccactatgcagtcattctacgaacagattgccgccttcaaaaccgtggaggaaaaaagcatcaaagagaccctcagcctcttgttcgacgacctcaaggcccaaaaactcgaccttagcaaaatctacttcaagaatgacaagtccctcaccgacctcagccagcaagtgtttgatgactacagtgtgattgggacagccgtcctcgagtacataactcagcagatagctcccaaaaacttggacaacccctccaagaaggaacaggagctcatagctaagaaaactgagaaagccaagtacttgtcactcgagacaatcaaactcgccctcgaggaattcaacaagcacagggacatcgacaagcagtgtaggttcgaagagatcctcgcaaacttcgccgcaatccccatgatctttgatgaaatcgctcagaacaaggacaatctcgctcagatcagcattaaataccaaaaccaggggaagaaggacttgctccaagccagcgccgaggatgacgttaaagccatcaaggatctcctcgatcagaccaacaacctcctccacaagctcaagatatttcacattagccagagtgaggacaaagccaacatcctcgataaagacgaacacttctatctcgtgttcgaggagtgttatttcgagctcgcaaatatcgttcccctctacaacaagatcaggaactatatcacccaaaagccatacagcgatgagaagtttaagctcaactttgagaatagcacattggccaacgggtgggacaagaacaaggaacccgacaacactgccatcctcttcatcaaagacgacaaatactacctcggggtgatgaacaagaagaacaacaagatctttgatgataaggccatcaaggagaacaaaggcgagggctacaagaaaatcgtgtacaaactcctccccggcgccaacaagatgctccccaaagttttcttctccgccaagtccatcaagttttataaccccagcgaggacatccttaggatcagaaaccattcaacccacaccaagaacggaagcccccagaaagggtacgagaaattcgagttcaacatcgaggactgcaggaagtttatcgatttttacaaacagtccataagcaagcaccccgagtggaaggacttcggttttagattctcagacacacagagatacaacagcatagacgaattctacagggaagtcgaaaatcaggggtacaagttgacctttgagaacatcagcgagagctatatagacagcgttgttaaccaggggaagctctacctcttccagatatacaacaaagacttctctgcctactccaaaggcaggcccaatctccatacattgtactggaaagccctctttgatgagaggaacctccaggacgtcgtgtataagctcaatggcgaagccgagctcttctataggaaacaatcaatccctaagaagatcacccaccccgccaaagaggctattgccaacaagaacaaagataaccccaagaaggagagcgtctttgagtacgacttgatcaaggacaagaggtttaccgaggacaagtttttcttccactgccccatcactatcaacttcaaatcttccggtgccaacaagtttaacgacgagattaacctcctcctcaaagagaaagccaacgacgtccacatcctcagtatagacaggggcgagaggcacctcgcctattacaccctcgtcgacgggaagggcaacatcatcaaacaggataccttcaacatcatcggaaacgacaggatgaagaccaactaccatgataagctcgccgccatcgaaaaagacagggacagcgcaaggaaggattggaagaagatcaataatatcaaggagatgaaggaggggtacctctctcaggtggtgcacgaaattgctaagctcgtgatcgagtacaatgccattgtcgttttcgaggacttgaatttcggcttcaagagaggcaggtttaaggtcgagaagcaggtttatcagaagctcgagaaaatgttgatcgagaagctcaactacctcgtcttcaaggacaatgagttcgacaagactggaggggttctcagagcctaccagctcaccgccccctttgagaccttcaagaagatggggaagcaaaccggcataatctattacgttcccgcaggattcacttctaagatctgccccgtgacaggcttcgttaatcagttgtacccaaagtacgagagcgtgtccaagtcacaggagttcttttccaaattcgacaagatctgctacaacctcgacaaaggatacttcgaattcagcttcgactacaagaatttcggggacaaggccgctaagggcaagtggaccattgccagtttcgggtccaggctcatcaattttaggaattccgacaaaaaccacaattgggacacgagggaggtctaccctaccaaagagctcgaaaagctcctcaaagactacagtatcgagtacggccatggtgaatgcatcaaggccgccatctgcggggagagcgacaagaagttcttcgccaagttgacctccgtcctcaataccatcctccagatgaggaacagcaaaaccggcaccgagctcgactaccttatcagccctgtggctgacgttaacgggaactttttcgactccaggcaggcacccaagaacatgccacaagacgctgacgccaacggcgcctaccacatcgggctcaagggcttgatgcttttgggcagaatcaagaacaaccaggaggggaaaaagctcaacctcgtgataaagaacgaggagtatttcgagttcgttcagaacaggaacaac

SEQ ID NO: 33 - DNA, 3900 bp, Artificial
  synthetic
atgtccatctatcaggagtttgtgaacaaatatagcctcagcaaaaccttgaggttcgaactcataccccaaggcaaaaccctcgagaacataaaggctagagggctcatcctcgacgatgagaagagggccaaggattacaagaaagctaagcagattatagacaagtatcatcaattctttattgaggaaatcctctcttccgtctgcatctccgaggatctccttcagaattactccgacgtctacttcaagctcaagaagagcgacgacgacaacctccagaaagacttcaagtctgccaaggacaccatcaagaagcaaattagcgagtacatcaaggacagcgagaagttcaagaacctctttaatcaaaatctcatcgatgccaagaagggccaagagtctgatcttatcttgtggctcaagcaaagcaaagacaacgggattgagctcttcaaggccaacagtgacatcaccgacatcgacgaggccttggagatcatcaagtcctttaaggggtggaccacttactttaaggggttccacgagaacaggaagaacgtctattccagcaacgacatccccaccagcatcatttacaggattgttgacgataacctcccaaagttcctcgaaaacaaagctaagtatgagtccctcaaggataaggcccccgaggccatcaactatgaacagatcaagaaggacctcgccgaggagctcaccttcgacatcgactacaagaccagcgaggtgaaccagagggtcttttcactcgacgaggtgtttgagatcgccaactttaataactacctcaatcagtccgggattaccaagttcaataccatcattgggggcaagtttgtgaatggggagaacactaagagaaagggtattaacgagtacatcaatttgtacagccaacaaatcaacgacaagaccctcaagaaatacaagatgagcgtcctcttcaagcagatcctttccgacaccgagtcaaagtccttcgtcatcgacaagctcgaagatgacagcgacgttgttaccaccatgcagagcttctatgaacagatcgccgccttcaagaccgttgaggagaagagcatcaaggagaccctctcactcctctttgatgacctcaaggcccaaaagctcgacctctccaaaatttacttcaagaatgacaagagcctcaccgacctcagccagcaggtcttcgacgactactccgtcatcggcaccgccgtgctcgagtatatcacccaacagatcgctcccaaaaacctcgacaatcccagcaagaaagaacaggaactcatcgccaagaagaccgagaaggccaagtacctctccctcgagacaatcaagctcgccctcgaggagttcaataaacacagagacatcgacaagcagtgcaggtttgaggagatcctcgccaatttcgccgccatccccatgatcttcgacgagatagcccaaaacaaggacaatctcgcccagatcagcatcaagtaccagaaccaaggcaagaaggatttgctccaggcctccgccgaggatgacgtgaaggctatcaaagatttgttggatcagaccaacaacctcctccacaagctcaaaatcttccacatcagccaatccgaagacaaggccaacatcctcgacaaggacgagcacttctaccttgttttcgaagaatgctacttcgagttggccaacatcgtccccctctacaacaagatcaggaactacatcacccaaaagccctactccgacgaaaagttcaaactcaactttgagaactctactcttgccaacgggtgggataagaataaggaacctgacaacaccgccatactcttcatcaaggacgacaaatactacctcggcgttatgaacaaaaagaacaacaaaatcttcgacgacaaggccatcaaagagaacaagggagaaggttacaagaagattgtgtacaagctccttccaggggccaataaaatgctccccaaggtgttttttagcgccaagagcatcaagttctacaacccctcagaggacatcctcaggatcaggaaccacagcacccacactaagaacggcagtccccagaagggttacgagaaattcgaattcaacatcgaggattgtaggaagttcattgatttctataagcaaagcatctccaaacaccccgagtggaaagactttggcttcagattcagcgacacccagagatacaactcaatcgacgagttctacagggaagtcgagaaccagggctataaattgacctttgagaacatctccgagtcctacatcgacagcgtcgtcaaccaggggaagctctatctctttcagatctacaacaaggacttcagcgcatatagcaagggaagacccaatctccataccctctactggaaggccctcttcgacgagaggaacctccaggacgtggtctacaagctcaatggggaggccgaattgttctacagaaagcagtcaatccccaagaagattacccacccagccaaagaggcaatagccaacaagaacaaggacaatcccaagaaggaatcagtgttcgagtacgacttgataaaagacaagagattcactgaagataagttctttttccactgccccatcaccatcaacttcaagtccagcggcgccaacaaattcaatgatgagatcaacctcctcctcaaggagaaggctaacgacgtccacatcttgagcatcgacagaggcgagaggcaccttgcctactacactctcgtcgacgggaaaggcaatatcattaagcaggatactttcaacatcatcggaaacgacaggatgaagactaattaccatgacaagctcgccgccatagaaaaggatagggactccgccaggaaagactggaagaagatcaataacatcaaggagatgaaggaggggtatctttcccaggtcgttcatgagatcgccaagctcgtgatagaatataatgccatcgtcgtcttcgaggatctcaactttggtttcaaaagggggagatttaaggtggaaaagcaggtctaccagaaactcgagaaaatgctcatcgagaagctcaattatctcgtgttcaaggacaacgagttcgacaagaccggcggggtcctcagggcatatcagcttaccgccccctttgagaccttcaagaagatggggaagcagaccggtatcatctactacgttcccgcagggtttaccagcaaaatctgtcccgtgaccggctttgtgaaccaactctacccaaaatatgaatcagtgtccaagtcccaggaattcttctccaaattcgacaaaatatgttataacctcgacaaagggtacttcgaatttagcttcgattacaaaaacttcggcgacaaagccgccaaggggaagtggaccatcgccagcttcgggtcaagactcatcaacttcagaaactccgataagaaccataactgggacaccagggaggtctaccccaccaaggagttggagaagctcctcaaggactatagcatcgagtacggtcacggggaatgcatcaaggccgccatctgcggcgaatccgataagaagttcttcgccaagctcacctccgtcctcaacaccatcctccagatgagaaacagcaagaccggcactgagctcgactacctcataagccccgtcgccgacgtcaacggaaactttttcgactcaagacaggcccccaaaaacatgccacaggacgccgacgccaacggcgcctaccacatcgggttgaaaggcctcatgctccttgggaggataaagaacaatcaagagggcaaaaagcttaacctcgtcatcaagaacgaggagtactttgaattcgttcagaacaggaataac

SEQ ID NO: 34 - DNA, 3900 bp, Artificial
  synthetic
atgtccatctatcaggagttcgtgaataagtatagcttgtccaaaacccttaggtttgagctcatcccacaggggaaaaccctcgagaatatcaaggccagggggctcatactcgacgacgagaagagggccaaagactacaagaaggccaagcagataatcgataagtaccaccaattcttcatagaagagatcttgagttccgtctgcatctccgaggaccttttgcagaactactccgacgtttacttcaaactcaagaagagcgacgacgacaacctccaaaaggacttcaaatccgctaaggacactatcaagaaacaaatctccgaatatatcaaggacagcgagaaattcaagaacttgtttaaccagaaccttattgacgccaaaaaggggcaggagagcgacctcattctctggctcaaacagagcaaggacaacggcatcgagctcttcaaggccaactccgacataaccgacattgatgaggccctcgagatcattaagtcctttaagggctggaccacctatttcaagggcttccacgagaacaggaagaatgtttacagcagcaacgacattcccacctccatcatctacaggatcgtcgacgataacctccccaaattcctcgaaaacaaggctaaatacgaatcccttaaggacaaggcccctgaagcaatcaactacgaacaaatcaagaaagacctcgccgaggagctcaccttcgacatcgactacaagacaagcgaggtgaaccagagggtgttcagtttggatgaggtttttgagatcgccaatttcaacaactacttgaaccagagcggcatcaccaagttcaataccatcatcgggggcaagttcgtgaacggcgagaacaccaaaaggaagggtatcaacgaatacatcaacctctacagtcaacagatcaacgacaagaccctcaagaagtataagatgagcgttctcttcaagcagatcctcagcgacactgagtctaagtccttcgttatagacaagcttgaggacgacagcgatgtcgtgaccaccatgcaatccttctacgaacagatcgccgccttcaagaccgtggaggagaagtcaatcaaggaaaccctcagcctcttgttcgatgatctcaaggctcaaaagctcgacctctcaaaaatctatttcaagaacgacaagtccctcaccgacctctcacagcaagttttcgatgactactccgtgataggcaccgccgttctcgagtacatcacccagcagatcgcccccaaaaacctcgacaacccctctaagaaggaacaggagttgatcgcaaagaagaccgagaaagccaagtacctctccttggagaccatcaagttggccctcgaagagttcaacaagcatagggacatcgacaagcagtgcaggttcgaggaaatactcgccaacttcgccgcaatccccatgatcttcgacgagatcgcccagaacaaagacaacctcgcccaaatcagtatcaagtaccaaaaccaggggaaaaaagacctcttgcaggcctcagccgaggacgacgttaaggctatcaaggaccttcttgaccagaccaacaatctcctccataaactcaaaatcttccacatctcacagtccgaagataaagccaacatcctcgacaaggacgagcacttctacctcgtctttgaggagtgctacttcgaactcgccaacatcgtccctctctacaataaaattaggaattatatcacacagaaaccctactctgacgaaaagttcaagctcaactttgagaatagtaccctcgccaatgggtgggataagaacaaagagcccgacaataccgccatcctctttatcaaggacgacaagtactatctcggggtcatgaacaagaagaacaataagatattcgacgataaggccatcaaagagaacaagggagaggggtacaaaaaaatcgtgtacaagcttctccctggggccaataagatgcttcccaaagtcttcttctccgctaagtccatcaagttctataaccccagcgaggacatccttaggatcaggaaccactccacccacaccaaaaacggctccccccaaaagggctatgagaagttcgagttcaacatcgaggactgcaggaaattcatagacttctacaagcagtccatctccaaacaccccgagtggaaggacttcgggttcaggttcagcgacacccaaaggtacaactccatcgacgaattttatagggaagtggagaaccaagggtacaagttgacctttgagaatatcagcgagtcctacatcgacagcgttgtcaaccaggggaagctctatctcttccaaatctacaacaaggatttctccgcctactccaaaggaagacccaatctccacaccctctattggaaggccctcttcgacgaaaggaacttgcaggacgtcgtttacaagctcaatggggaggccgaactcttctacagaaagcaatcaatccccaaaaagataacccaccccgctaaagaagctatcgccaacaagaacaaagacaaccccaaaaaagaatccgtgttcgaatacgacctcatcaaagacaagaggttcactgaagacaaattcttcttccactgccccatcaccatcaacttcaagagcagcggggccaacaaattcaacgacgaaatcaacctcctcctcaaagagaaagccaacgacgtgcacattctcagcatcgataggggtgagaggcacctcgcctactacaccctcgttgatggcaaggggaacatcataaaacaagataccttcaatatcatagggaatgacaggatgaagaccaactaccacgataagcttgcagccatcgagaaggacagggattccgcaagaaaggattggaagaaaatcaacaacatcaaagagatgaaggagggttacctctcccaggtggttcacgaaatagccaagctcgtgatcgagtacaacgccatagtggtgttcgaggacctcaactttggctttaagagggggaggttcaaggttgagaagcaagtctaccagaagctcgagaaaatgctcatagaaaagctcaactatctcgtcttcaaggacaacgagtttgacaaaaccggtggtgtcctcagagcatatcagctcaccgctcccttcgagaccttcaagaagatgggaaaacagaccgggatcatatactacgtgcccgccgggttcacctctaagatctgtcccgttaccggcttcgtcaatcagctttaccccaagtatgagtccgtctccaaatcccaggagttcttttccaagttcgataagatttgctacaacttggacaaggggtacttcgagttctccttcgactacaagaacttcggggacaaagccgccaaagggaaatggaccatcgcctcctttggcagtagactcatcaacttcaggaactccgacaagaaccacaactgggataccagggaggtctaccccactaaggaacttgagaagctcctcaaagactacagcatcgagtacgggcacggggagtgcatcaaggccgccatctgcggtgaaagcgacaagaagtttttcgccaagctcaccagtgtgctcaacaccatattgcaaatgaggaattctaaaaccgggacagagctcgactatctcatcagtcccgttgccgacgtcaacggcaacttctttgactccaggcaggcccccaagaacatgccacaggacgccgacgccaatggcgcctaccacatcgggctcaaggggctcatgcttctcggcaggattaagaacaaccaagagggcaagaagttgaacctcgtgatcaaaaacgaggagtactttgagttcgtgcagaataggaacaac

SEQ ID NO: 35 - DNA, 3900 bp, Artificial
  synthetic
atgagcatctatcaggagtttgttaacaagtattccctcagtaagacactcaggttcgagctcatcccacaaggcaagacactcgagaacatcaaggccaggggactcattctcgacgacgagaagagagcaaaggactacaagaaagctaaacagataatcgataaataccatcagtttttcatcgaggagatcttgagcagcgtgtgcatctccgaggaccttctccagaactatagcgatgtctactttaagctcaaaaagagcgacgacgacaatttgcagaaggatttcaagagcgcaaaggataccataaagaagcagatcagtgaatacattaaggacagcgagaagttcaagaacctcttcaaccagaatctcatcgacgccaagaaggggcaggagagcgacttgatcctctggctcaaacagtccaaggacaatggtatcgagctcttcaaggccaactccgatattaccgacatcgatgaagccctcgagataatcaaaagtttcaagggatggaccacttacttcaaagggttccacgagaacagaaagaacgtttactcttcaaacgatatccccacaagtatcatctacaggatcgtggacgacaacctccccaagttcctcgagaacaaggccaagtacgagtcactcaaagataaagcccccgaggctatcaactacgagcaaataaagaaggacctcgctgaagagctcaccttcgacatcgattacaagaccagcgaggtcaaccagagggtcttcagtctcgatgaggtgttcgagatcgcaaactttaataactacctcaatcagagtggcatcacaaagttcaacaccatcatcggtgggaaattcgttaacggggagaacaccaagagaaagggaatcaacgaatatataaacctctacagccaacagataaatgataagaccctcaagaagtacaagatgagcgtcctctttaagcagatcctttctgacaccgagagcaagagttttgttatcgacaagcttgaggacgacagtgacgtcgtcactaccatgcagagcttttacgagcagatcgccgccttcaagactgtggaggagaagtctatcaaagagactctctccctccttttcgacgacctcaaggcccagaaactcgatctctctaagatctacttcaagaacgataagagtttgaccgacctctcccagcaggtgttcgatgattacagcgtgatcgggaccgccgtcctcgagtacatcacacagcagatcgcccccaagaacctcgacaacccaagcaagaaggagcaagagctcattgccaagaagaccgagaaagctaagtacctcagcctcgagactatcaaactcgctctcgaggagtttaataaacatagagacatcgataaacagtgcaggttcgaggagatcctcgccaactttgccgccatacccatgatatttgatgagatcgcccaaaacaaggataaccttgcccagatcagcatcaagtaccagaaccagggcaaaaaggacctcttgcaggcctccgccgaggacgatgttaaggccatcaaggacctcctcgaccagaccaacaacctcctccataagctcaaaatctttcacatctcccagtccgaggataaggccaacatcctcgacaaggacgagcacttctacttggtcttcgaggagtgctacttcgagctcgctaacatcgtgccactctataacaagatcaggaactacatcacccaaaagccctactctgacgagaagttcaagctcaacttcgagaacagcaccctcgccaacgggtgggacaaaaacaaagaacccgacaacactgccatcctcttcatcaaagacgacaaatactatctcggcgtgatgaataaaaaaaacaacaagatatttgatgacaaagccatcaaggagaacaagggcgaaggttacaagaaaatcgtctacaagctcctccccggcgccaacaagatgctccccaaggtcttctttagtgcaaagtcaatcaagttttataacccctccgaagacatcctcaggattaggaaccactccacccacaccaagaacggcagccctcaaaaagggtacgagaaattcgagttcaacatcgaggactgcagaaaattcatagacttctacaagcaaagcatcagcaagcaccccgaatggaaagatttcggctttaggttcagcgacacccaaagatacaactccatcgacgaattctacagggaggtcgagaaccaggggtacaagctcaccttcgaaaacatctccgagtcatacatcgactctgtggttaaccagggaaaattgtacctcttccagatttataacaaggacttcagcgcctactccaaggggagaccaaatctccacaccctctactggaaggccttgtttgacgaaaggaacttgcaggacgttgtttacaaactcaacggggaggctgagctcttttacaggaagcagtccatccccaagaaaatcacccatcccgccaaggaggccatcgccaataagaataaagacaaccctaaaaaggagagcgtgttcgagtacgacctcatcaaagacaagaggttcaccgaggacaagttcttcttccactgccccatcaccatcaacttcaagagcagcggggccaacaagttcaacgatgagataaacttgctccttaaggagaaggccaacgacgttcacattctctccatagacaggggggagaggcaccttgcttactacacccttgtcgacggtaagggcaatattataaagcaagacaccttcaacatcatcggcaacgacaggatgaagactaactaccatgacaagctcgccgccatcgagaaggatagggactccgcaaggaaggactggaagaagatcaacaacatcaaagagatgaaggagggctacctcagccaggtcgttcatgagatcgccaagctcgttatcgagtataacgccatcgtcgtctttgaggacctcaatttcggattcaagagggggagattcaaggtggagaagcaggtctaccagaagctcgagaagatgctcattgaaaagctcaattacctcgtgttcaaggacaacgagttcgacaagacaggtggcgtgctcagggcctaccaattgaccgccccctttgaaacctttaagaagatgggaaagcagaccgggatcatatattatgtccccgccggcttcacaagcaagatttgccccgttaccggattcgtcaaccaactctacccaaaatatgagagtgtcagtaagtcacaggagttctttagcaaattcgacaaaatctgctataatctcgacaagggctacttcgagttcagcttcgactataagaatttcggggacaaagccgccaagggcaagtggaccatcgccagctttggcagcaggctcatcaacttcaggaactccgacaagaaccacaactgggacaccagggaggtgtaccccaccaaggagctcgaaaaactccttaaggactattccatagagtacgggcacggggagtgcatcaaggccgccatctgcggcgagtccgataaaaagttcttcgccaagctcacctctgtccttaataccattctccaaatgagaaattccaagaccgggaccgagctcgactacctcatcagcccagtcgccgacgtgaatgggaacttcttcgactcaaggcaggcccccaagaacatgcctcaggacgccgacgccaacggcgcctatcacataggcctcaagggtctcatgctcctcgggaggatcaagaacaaccaggagggcaagaagctcaacctcgttatcaagaacgaggagtacttcgagttcgttcagaataggaacaac

SEQ ID NO: 36 - DNA, 3900 bp, Artificial
  synthetic
atgtctatttaccaggagttcgtgaacaagtacagcctcagcaagaccctcagattcgagctcatcccccaggggaaaaccctcgagaatattaaggccagagggcttattctcgacgacgagaagagggccaaagactataagaaggcaaagcagatcatcgacaagtaccaccagtttttcatcgaggagatcctcagcagtgtgtgcatcagcgaagatctcctccagaactactctgacgtctacttcaagctcaaaaaaagcgacgacgacaacttgcaaaaggacttcaaatccgccaaggatactatcaagaagcaaatcagcgaatatatcaaggactccgaaaagttcaagaatctctttaatcaaaatctcatcgacgccaaaaagggccaagagtctgacttgatcctctggctcaagcagtccaaagacaatgggatcgagctcttcaaagcaaactctgacattactgacattgacgaggccctcgagatcatcaagtcattcaaggggtggaccacatacttcaaggggttccacgagaacaggaagaacgtgtacagctccaacgacatacccaccagcatcatatacagaatcgttgacgataacctccccaagttccttgaaaataaggccaagtatgagtccttgaaggacaaagctcccgaggccataaactacgagcagataaagaaggatcttgcagaggagctcaccttcgacattgactacaagaccagcgaggttaaccagagagtcttctcactcgacgaggtgttcgagatcgccaacttcaacaattatttgaaccagtcagggataaccaaattcaacaccattatcggtggcaaattcgtgaacggggagaacaccaagaggaaaggtatcaacgagtacatcaatctttattctcaacagatcaacgacaagacactcaagaaatacaagatgagcgtcctctttaagcagatactcagcgacaccgaaagcaaatcctttgtcatcgataagctcgaagacgattccgacgtggtcaccaccatgcaaagcttctacgagcagatcgccgctttcaaaaccgtcgaagagaagagtatcaaggagactctcagccttttgttcgacgacttgaaggcccagaaacttgacctctcaaagatctacttcaagaacgataagtctctcactgacctctcccagcaggtcttcgacgattacagcgtcattggaaccgctgtgttggagtacattacccagcagattgcccccaagaacctcgacaacccttctaaaaaggagcaagaactcatagccaagaagaccgagaaggccaagtacctctccctcgagacaatcaagctcgccttggaagagttcaataagcacagggatatcgacaagcagtgtaggttcgaggagatcctcgctaactttgccgccatacccatgatctttgacgagatcgcccagaacaaagacaatctcgcccagatatccataaagtaccagaatcagggtaaaaaggatctcctccaagccagcgccgaggacgacgttaaggcaatcaaggacctccttgaccagaccaataacctcctccacaagctcaagatctttcacattagccagagcgaggataaggcaaatatcctcgataaggacgagcacttctacctcgtgttcgaagagtgctacttcgaactcgccaatatcgtccccttgtacaacaaaatcagaaactacataacccagaagccatattccgacgagaaatttaagctcaacttcgagaactccacactcgccaacgggtgggacaaaaacaaagagcctgataataccgccatcctcttcatcaaggacgacaagtattacctcggagtgatgaacaagaagaacaacaaaatcttcgatgacaaggccatcaaggagaataagggcgagggctataaaaagatcgtgtacaagctcctccccggggccaataagatgctccccaaggtgttcttctccgccaagagtataaagttctacaaccccagtgaagacatcttgagaatcaggaaccacagcacacacactaagaacggaagcccccagaagggctacgaaaaattcgagttcaacatcgaggactgcaggaaattcatcgacttctataagcaatccatatccaagcaccccgagtggaaggactttggcttcagattcagtgacacccaaaggtataacagtattgacgaattctacagggaggtcgagaaccagggctacaagctcaccttcgagaatatatccgagagctacatcgactccgtggtcaatcaggggaagctctatctcttccagatctacaacaaggacttctctgcctactcaaaggggaggcccaacctccacaccctctactggaaggcattgtttgacgagagaaatctccaggacgttgtctacaagctcaacggggaagccgagctcttctacaggaagcaatcaatcccaaaaaaaatcactcatcccgccaaagaggccatcgccaacaaaaacaaagacaaccccaagaaagagagcgtctttgagtacgacctcatcaaagacaagagattcaccgaggataagttcttcttccactgccccatcactatcaacttcaagtcatctggcgctaataaattcaacgacgagatcaacttgctccttaaggagaaggccaacgacgtgcatatcctcagcatcgacaggggggaaaggcatctcgcatactacaccctcgttgacggcaagggcaatattataaagcaggatacctttaacatcatcggcaacgacagaatgaagaccaactaccacgacaagctcgcagccatcgagaaggacagggactcagccaggaaggactggaagaagatcaacaatatcaaagaaatgaaggaggggtacctctcccaggtggttcatgagatcgcaaagttggtgatcgagtataacgccatcgtcgtcttcgaggacttgaatttcggcttcaaaaggggcaggttcaaagtcgaaaagcaggtctatcagaagctcgagaaaatgctcatcgagaagcttaattacctcgtcttcaaagacaacgagttcgacaagaccggtggcgtcctcagggcctaccaacttaccgcccccttcgaaacctttaagaagatggggaaacagaccggcatcatttactacgtgcccgccggtttcacttcaaagatctgtcctgttaccggattcgtcaaccagctctaccctaagtatgaaagcgtgtccaagagccaggagttcttttccaagttcgacaagatatgttacaaccttgacaaggggtactttgagttctcattcgactacaagaacttcggggacaaagccgcaaagggtaaatggacaatcgccagcttcggaagcaggctcatcaacttcaggaacagtgacaagaaccacaattgggacacaagggaagtgtatcctaccaaggagctcgagaaactcctcaaggactactctatcgaatacggccatggcgaatgcatcaaggccgccatctgcggggagtccgataagaagttcttcgccaagctcacctccgttctcaacactatcctccagatgaggaacagcaagaccggcaccgagttggactacctcatctctcccgtcgccgacgttaatggaaacttcttcgatagcaggcaggcccccaaaaacatgccacaagacgccgacgccaacggtgcttatcacattgggttgaagggacttatgttgctcgggaggatcaagaacaatcaggaaggcaagaaactcaacctcgtgatcaagaatgaggagtacttcgagtttgtgcagaacagaaacaac

SEQ ID NO: 37 - protein, 1320 aa, Unknown
  bacterial
MQQYQVSKTVRFGLTLKNSEKKHATHLLLKDLVNVSEERIKNEITKDDKNQSELSFFNEVIETLDLMDKYIKDWENCFYRTDQIQLTKEYYKVIAKKACFDWFWTNDRGMKFPTSSIISFNSLKSSDKSKTSDNLDRKKKILDYWKGNIFKTQKAIKDVLDITEDIQKAIEEKKSHREINRVNHRKMGIHLIHLINDTLVPLCNGSIFFGNISKLDFCESENEKLIDFASTEKQDERKFLLSKINEIKQYFEDNGGNVPFARATLNRHTANQKPDRYNEEIKKLVNELGVNSLVRSLKSKTIEEIKTHFEFENKNKINELKNSFVLSIVEKIQLFKYKTIPASVRFLLADYFEEQKLSTKEEALTIFEEIGKPQNIGFDYIQLKEKDNFTLKKYPLKQAFDYAWENLARLDQNPKANQFSVDECKRFFKEVFSMEMDNINFKTYALLLALKEKTTAFDKKGEGAAKNKSEIIEQIKGVFEELDQPFKIIANTLREEVIKKEDELNVLKRQYRETDRKIKTLQNEIKKIKNQIKNLENSKKYSFPEIIKWIDLTEQEQLLDKNKQAKSNYQKAKGDLGLIRGSQKTSINDYFYLTDKVYRKLAQDFGKKMADLREKLLDKNDVNKIKYLSYIVKDNQGYQYTLLKPLEDKNAEIIELKSEPNGDLKLFEIKSLTSKTLNKFIKNKGAYKEFHSAEFEHKKIKEDWKNYKYNSDFIVKLKKCLSHSDMANTQNWKAFGWDLDKCKSYETIEKEIDQKSYQLVEIKLSKTTIEKWVKENNYLLLPIVNQDITAEKLKVNTNQFTKDWQHIFEKNPNHRLHPEFNIAYRQPTKDYAKEGEKRYSRFQLTGQFMYEYIPQDANYISRKEQITLFNDKEEQKIQVETFNNQIAKILNAEDFYVIGIDRGITQLATLCVLNKNGVIQGGFEIFTREFDYTNKQWKHTKLKENRNILDISNLKVETTVNGEKVLVDLSEVKTYLRDENGEPMKNEKGVILTKDNLQKIKLKQLAYDRKLQYKMQHEPELVLSFLDRLENKEQIPNLLASTKLISAYKEGTAYADIDIEQFWNILQTFQTIVDKFGGIENAKKTMEFRQYTELDASFDLKNGVVANMVGVVKFIMEKYNYKTFIALEDLTFAFGQSIDGINGERLRSTKEDKEVDFKEQENSTLAGLGTYHFFEMQLLKKLSKTQIGNEIKHFVPAFRSTENYEKIVRKDKNVKAKIVSYPFGIVSFVNPRNTSISCPNCKNANKSNRIKKENDRILCKHNIEKTKGNCGFDTANFDENKLRAENKGKNFKYISSGDANAAYNIAVKLLEDKIFEINKK

SEQ ID NO: 38 - DNA, 3960 bp, Artificial
  synthetic
atgcagcaatatcaggtgtctaagacagtgcgtttcgggcttaccttaaaaaactcagaaaaaaaacatgctacccacttacttttgaaggatctcgttaatgtttctgaagaaagaataaaaaacgagattactaaagatgataagaaccagtctgagctgtcttttttcaatgaggtgatagaaaccttggatcttatggataagtacattaaggactgggagaactgcttttataggacagaccaaatccagttgacaaaggagtactataaagtgatagcaaaaaaggcttgctttgattggttttggacaaatgatagaggtatgaagttcccaacatcctccataattagctttaattccctaaagtcctcagacaagtcaaagacttcagataatttggatagaaagaagaagatccttgattattggaagggaaacatttttaaaactcagaaagctattaaggatgttttggatattacagaggacatacaaaaagcaatagaggaaaaaaaatcacatcgtgaaattaatagagtaaatcataggaagatgggcatccacctcattcacttgattaatgatactcttgtgcctttgtgtaatggaagtatcttcttcgggaacatctcaaaactggatttctgtgagtccgaaaatgaaaagctcattgatttcgccagcacagagaaacaagacgagaggaagttcctgctttcaaaaataaacgaaattaagcagtacttcgaggataatggagggaacgttccatttgctagagcaaccctgaaccgacacactgcaaaccaaaaacctgatcgttataacgaggaaatcaagaagctggtgaacgagcttggagtgaacagccttgtgcgatcccttaagtctaagaccatagaagagattaagacacattttgagttcgagaataagaacaagattaacgaattgaaaaattctttcgttctttctattgttgaaaagatccaattgtttaagtacaaaactataccagcatcagttagatttctgctagcagattactttgaggagcaaaagctttctactaaggaggaagctttaactattttcgaggagatcggaaagccccaaaacataggcttcgactatattcagcttaaggagaaagataacttcacacttaaaaagtatcccttaaagcaagcattcgactacgcttgggagaacttagctagactagatcaaaatccgaaagctaatcagttctctgttgatgaatgtaagaggtttttcaaggaagttttctcgatggagatggataacataaacttcaaaacctatgctctcttactcgctttaaaggagaagactacagcttttgacaaaaagggggaaggcgccgcaaaaaataaatctgagattatcgaacagatcaagggcgtgtttgaggagttggatcaaccctttaagatcattgccaatactctaagggaggaggttataaaaaaagaggatgagttaaatgtactcaaacgacaatatcgtgaaaccgataggaagatcaaaacattgcagaacgaaatcaagaagataaagaaccaaattaaaaacttggaaaacagcaagaagtattcgttccccgaaattattaagtggatcgacttgaccgagcaagaacaactactggataagaacaaacaggcaaagagtaattatcaaaaagccaagggtgacttgggtttgattcgcgggagccaaaaaacatccattaatgattatttttacttgaccgataaagtttatcggaagcttgcccaagatttcgggaagaagatggcagatttaagagaaaaattgctcgacaagaacgatgtaaacaaaattaagtatttgtcttacatcgtaaaggacaatcaaggataccagtacaccctgctaaaacctttggaagacaaaaacgcagaaattattgagcttaaatctgagcccaatggtgatcttaagttgttcgaaataaagtctcttacctctaagacattgaacaagtttatcaaaaataagggcgcttataaggaatttcattctgccgaattcgaacataaaaagattaaggaagattggaaaaactacaaatacaattcggattttattgttaagttaaagaagtgtctgtcacattccgacatggcaaacactcagaattggaaggccttcgggtgggatttggataagtgcaaatcttatgaaacaattgaaaaagaaattgatcaaaagagttatcaactcgtcgagatcaaactctctaagacaaccattgaaaagtgggtgaaggaaaataattacttgcttcttcccatcgttaaccaagatattaccgcagagaagcttaaggttaacacaaaccagtttactaaggattggcaacatatttttgagaaaaaccctaaccacagacttcacccagagtttaacatcgcataccggcaacccactaaagattatgctaaagaaggtgaaaaacgctactctcggttccaactgactggtcaatttatgtatgaatacatccctcaagacgccaattatatctcacgcaaggagcaaattacactttttaacgataaggaagagcagaaaattcaagtcgaaactttcaacaaccaaattgcaaagattctaaatgcagaggatttttatgtaattggaatagatcgtggaatcactcaattagctaccctttgtgtgcttaacaagaacggagttattcagggtgggttcgaaattttcactagggagttcgactatacgaacaaacagtggaaacatacaaagttgaaggaaaaccgtaacatccttgatatctcaaatttgaaggtagaaacgaccgttaacggcgaaaaggttctcgtggatctaagtgaagtaaagacatacctgagggacgagaatggtgaaccaatgaagaatgaaaagggcgtgatattgaccaaagataacctgcagaagatcaagttaaaacagctagcttacgatcgcaaactacaatacaagatgcaacatgaacctgagttggtgctatcgtttctggatcgtctcgaaaacaaagaacaaataccgaaccttcttgcatcaaccaaattgatttccgcctataaggaaggaactgcttacgcagatattgacatcgaacaattttggaatattttgcaaacgttccagacaattgttgacaagtttggcgggattgaaaatgcaaaaaagaccatggaattccgtcagtatactgaacttgatgccagttttgatcttaaaaatggagttgttgctaatatggttggcgtcgtaaaattcattatggagaagtataactataagactttcatagccttagaggaccttacttttgcattcggtcagtctattgatggcatcaacggtgagagacttcgatccactaaggaagacaaagaagttgatttcaaagagcaggagaatagcaccttagcgggtttgggtacctaccactttttcgaaatgcaactcctaaaaaagttaagcaagacccaaataggcaacgagattaaacactttgtgcctgcttttcgatccaccgagaattacgagaagattgtgcgcaaggataagaacgttaaagccaaaattgtgagctacccttttgggatcgttagcttcgttaatcctaggaatacttccataagttgtccaaactgtaagaatgctaacaagagtaataggatcaaaaaggagaatgacagaattctctgtaagcacaatattgaaaagacaaagggcaattgtggtttcgataccgcaaattttgatgaaaataaacttcgtgctgagaacaagggcaagaacttcaaatatatttcaagtggcgatgctaacgcagcttataacatagctgttaaactccttgaagacaaaattttcgaaattaataaaaag

SEQ ID NO: 39 - DNA, 3960 bp, Artificial
  synthetic
atgcagcaatatcaggttagcaaaactgtgagattcggcttgacactcaagaactccgaaaagaagcatgctactcacctcctcctcaaggacctcgtcaacgttagcgaggagagaatcaagaacgagataaccaaggacgataagaaccaatcagagcttagtttcttcaatgaggtgatagagaccctcgacctcatggataagtatatcaaagactgggaaaactgtttctacaggaccgatcagatccagctcaccaaggagtactacaaggtcatcgccaagaaggcctgcttcgactggttttggaccaacgatagggggatgaaattccccaccagctccatcatcagcttcaacagcctcaagtccagtgacaagtccaagaccagcgataaccttgacagaaagaagaaaatcctcgactactggaagggtaacatcttcaaaacccagaaggccatcaaagatgttcttgacatcactgaggacatccagaaggccatcgaggagaaaaaatcccacagggagatcaacagagtcaatcacaggaagatggggatccatttgatccaccttatcaacgacaccctcgtgcccctctgcaacggatccatcttcttcggcaacatcagcaagcttgacttctgcgagtccgagaacgagaagctcattgactttgcctccacagagaagcaggacgagaggaagttcctcctctccaaaatcaacgagatcaagcagtattttgaagacaacggcgggaacgttccctttgccagggccaccctcaacaggcacaccgccaaccagaagcctgacaggtacaatgaagaaatcaaaaagcttgtgaacgagctcggggtgaactccctcgttaggtctctcaagtccaagaccatcgaagagatcaagacccacttcgagtttgagaacaagaacaagatcaacgagctcaagaactccttcgtcctctcaatagtcgagaagatccaactcttcaagtacaagaccatccccgccagtgttaggtttctcttggccgactacttcgaagaacagaagctctccaccaaagaggaggccctcaccatatttgaggaaatcgggaagcctcagaacataggattcgactacattcagcttaaagaaaaggacaatttcaccctcaagaaataccctctcaagcaagcattcgactacgcctgggagaacctcgccagactcgaccaaaaccccaaagccaaccagttctccgtggacgagtgcaagaggttctttaaggaagtgttctctatggagatggacaatattaacttcaagacttatgcccttctcctcgctctcaaggagaagaccacagcattcgataaaaagggcgagggcgccgctaagaacaagagcgagatcatcgagcagatcaagggtgtcttcgaagaattggaccagcccttcaagattatcgccaacaccctcagggaagaggttataaaaaaggaggatgagctcaacgttctcaagaggcagtacagggagacagataggaagatcaaaacactccagaacgagatcaagaagatcaagaaccaaatcaagaaccttgagaactccaagaagtactcatttcccgagatcatcaaatggatcgatctcaccgagcaagagcagctcctcgacaagaacaagcaggccaagtccaactaccagaaggccaagggtgatctcggcctcatcagggggtcccaaaaaacatccatcaatgactatttttacttgaccgataaggtctacaggaagctcgcccaagacttcggcaagaagatggctgacctcagggagaagcttctcgacaagaacgacgtcaataagatcaaatatctcagctacatcgttaaggacaatcagggataccagtacacactcttgaaaccactcgaggacaaaaacgccgagatcatcgagctcaagtctgaacccaatggcgacctcaagctcttcgaaatcaaaagtctcaccagtaagaccctcaacaaattcatcaagaacaagggtgcctataaggagtttcatagcgccgagttcgaacataagaaaatcaaagaggactggaagaattacaagtacaattctgatttcatcgtgaagctcaagaagtgcttgagccactccgatatggccaacactcagaactggaaggccttcgggtgggacctcgataagtgcaagtcctacgaaacaatcgaaaaggagattgatcaaaagtcctatcagctcgttgagatcaagctctcaaagaccaccatcgagaaatgggtgaaggagaacaactacctcctcctccccatcgtgaaccaagatatcacagccgagaagttgaaggtgaacaccaatcagttcactaaggactggcagcacatcttcgaaaagaaccccaaccacaggctccacccagagttcaacatcgcctacaggcaacccactaaagactacgccaaggaaggcgaaaaaaggtactccaggttccaactcacagggcagttcatgtacgagtacatacctcaggacgctaactacatcagcaggaaggaacagatcaccctctttaatgataaggaggaacaaaagattcaggtggagacattcaacaaccagatagccaaaatcctcaacgccgaggacttctacgtgatcggcatcgacagaggcattacccagctcgccactctctgcgtgctcaacaagaacggagtcatccagggggggtttgagatcttcacaagggaatttgattacaccaacaagcagtggaaacataccaagctcaaggaaaataggaacatcctcgacatctcaaaccttaaggtcgaaacaaccgtcaatggggagaaggttctcgtcgacctcagtgaggtcaaaacctacctcagggatgaaaacggggagcccatgaagaacgagaagggggtcatactcaccaaggacaacctccagaaaatcaaactcaagcagctcgcctacgacaggaagctccagtataagatgcagcatgaacccgagctcgtcctcagcttcctcgacaggctcgagaacaaggagcaaatccctaacctcctcgccagcaccaagctcatctccgcctacaaggaaggaactgcctatgcagatatcgacattgagcagttctggaatatcctccaaaccttccagaccatcgtggacaagttcgggggtattgagaacgccaagaagacaatggagtttaggcaatacaccgagctcgacgcttcattcgacctcaagaatggggttgtggccaacatggttggagttgtcaaattcatcatggagaagtacaactacaagaccttcatagccctcgaggacctcacctttgccttcggtcagagtatcgatgggataaacggcgaaaggctcaggagtaccaaggaggacaaggaggtcgacttcaaggagcaggagaacagcaccctcgccgggttgggcacataccatttttttgagatgcaactcctcaagaagctctctaagacccagatcggcaatgagatcaaacacttcgtccccgcctttaggtccactgagaactacgagaaaatcgtgaggaaagataaaaacgttaaggctaagatcgtctcttatccctttgggatcgtctcattcgtgaaccccaggaatacctccataagctgcccaaactgcaaaaacgccaacaagagtaataggataaagaaggaaaacgataggatactctgcaagcataacatcgaaaagaccaaaggcaactgtggtttcgatactgccaacttcgatgagaacaagttgagggcagagaacaagggcaagaattttaagtacatctcatccggcgacgccaacgccgcatacaacatagcagtcaagctcctcgaggacaagatcttcgaaatcaacaagaag

SEQ ID NO: 40 - DNA, 3960 bp, Artificial
  synthetic
atgcagcagtaccaagtctccaaaaccgtgagattcgggctcactctcaagaatagcgagaagaagcatgccacccatctcctcctcaaggaccttgttaatgtttccgaggagagaatcaaaaacgagataacaaaggacgacaagaaccagtcagagctcagcttcttcaacgaggtgatcgagacactcgatttgatggacaagtacatcaaggactgggagaactgcttctataggaccgaccagattcagctcacaaaagaatattacaaggttatcgccaaaaaggcatgtttcgactggttttggaccaacgacagaggcatgaagttccccaccagcagcataatctcctttaactctctcaagagctccgataagtccaaaaccagcgacaaccttgataggaagaaaaagattctcgactactggaagggcaacattttcaagacacagaaggccatcaaggacgtgctcgacattaccgaggacatccagaaggcaatcgaggaaaagaaatcacatagggagataaacagagtgaatcacagaaaaatgggaatccacttgatccacctcatcaacgacacacttgtgcccctctgcaacgggtccatttttttcggtaacatcagcaagctcgacttctgcgagagtgagaacgagaaactcatcgacttcgccagcaccgagaagcaagatgaaagaaagttccttctcagcaagatcaacgaaattaaacagtacttcgaggacaatggcggcaacgtgcctttcgccagggccactctcaataggcacaccgccaaccagaagccagacaggtacaacgaagagatcaagaagctcgttaacgaattgggagtcaactccctcgtcagaagcctcaagtcaaagactatcgaggagatcaagacccatttcgagttcgagaacaagaataagattaacgagctcaagaatagcttcgtcctctccatcgtcgagaagatccaactcttcaaatacaagaccatccccgccagcgtcaggttcctcctcgccgactatttcgaggagcaaaagctctccaccaaagaagaagcccttacaattttcgaggaaataggcaagcctcagaacatcgggttcgactacatccagcttaaggagaaggacaatttcaccctcaaaaagtaccccctcaagcaggccttcgactacgcctgggagaatctcgccaggctcgaccaaaatcccaaggccaaccagttctcagtggatgagtgcaagagattcttcaaggaagtcttcagcatggagatggacaacatcaacttcaagacctacgcccttctcttggctttgaaggagaaaaccaccgcctttgacaaaaaaggcgagggggctgccaaaaacaagagcgaaatcatcgagcaaattaagggcgtcttcgaggagctcgaccagcccttcaaaataatcgccaacaccttgagggaggaagtcatcaagaaggaggacgagctcaacgtgctcaagagacagtacagggagacagatagaaaaatcaagaccctccagaacgagatcaagaagattaagaaccagatcaaaaacttggagaacagcaagaagtactcctttccagaaatcataaagtggatagacctcaccgagcaggagcagctcctcgataagaacaagcaggccaagtccaactaccagaaagctaagggcgatttgggcctcatcagggggtcacagaagacctccataaacgactacttttaccttaccgacaaggtgtacagaaagcttgcccaggacttcggcaaaaagatggccgacctcagggagaagctcctcgacaaaaatgatgtcaataaaatcaagtacctctcctacatagtcaaagacaaccaggggtaccagtatactctcctcaaacccctcgaggataaaaacgccgaaataatcgagctcaagtccgaacccaatggcgacctcaagctctttgaaatcaagtccctcacaagcaagaccttgaataagtttatcaagaacaagggagcctataaggagttccacagcgccgagtttgaacacaaaaagatcaaggaggactggaagaactacaagtacaacagcgacttcatcgttaagctcaagaagtgcctcagccactccgacatggccaacacccagaactggaaggccttcgggtgggacctcgacaagtgcaagtcctacgagaccatcgagaaggaaatcgaccagaagagttaccagcttgttgagattaagttgagcaagacaaccatcgagaagtgggtcaaggaaaataattacctcctcctccccatagtcaaccaggatatcaccgccgagaagctcaaagtcaacaccaaccagtttaccaaagattggcagcacatcttcgaaaagaacccaaaccacaggctccaccccgagttcaatatcgcctacaggcaacccactaaggattacgctaaagagggcgagaagaggtacagcaggttccagctcactggccagtttatgtacgagtatatcccccaggacgccaactacatttccaggaaagagcaaatcaccctcttcaacgacaaggaggaacagaagatccaggtcgagacatttaacaaccagatcgcaaaaatcctcaatgctgaagatttctatgtcatcgggatcgacagggggatcacccagctcgctaccctctgcgttctcaataagaacggagtgatccaggggggcttcgagatctttaccagggagtttgactataccaataagcaatggaaacataccaagctcaaggagaacagaaatatcctcgacatcagcaacttgaaggttgaaaccactgtgaacggcgagaaggtactcgtcgacttgagtgaggtgaaaacatacctcagggacgaaaacggtgagcccatgaagaatgagaagggggtgatcctcaccaaggacaatctccagaagatcaagttgaagcagttggcctacgacaggaagctccaatacaaaatgcagcatgagcccgagctcgtgctctccttcctcgataggctcgagaacaaggagcagatccccaatctcctcgcctccaccaaactcatctctgcctacaaggagggcaccgcctacgccgacatcgacatcgagcagttttggaacatcctccaaacctttcagaccatcgtcgacaaatttgggggcatcgagaacgctaagaagacaatggagtttagacaatataccgagctcgacgcctcctttgacctcaaaaacggcgtcgtcgccaacatggtgggcgtggttaagttcataatggaaaagtacaactacaagactttcatcgcactcgaggatctcacctttgcatttggacaaagcatcgacggcatcaatggagagaggctcagaagcacaaaggaggacaaggaggtcgacttcaaggagcaggaaaactcaactctcgctggcctcggcacctaccacttcttcgagatgcagctcctcaagaagctctccaaaacccagatcggaaacgagattaagcacttcgtccctgccttcaggtctaccgagaactacgagaagatcgtcaggaaggacaaaaatgtcaaagccaaaatcgtgtcctacccattcgggatcgtcagcttcgttaaccccaggaacacctccatcagctgccccaattgcaaaaatgccaacaagtctaacagaataaagaaggagaatgataggatcttgtgcaagcacaacattgaaaaaaccaaggggaactgtggttttgacaccgcaaatttcgacgagaacaagcttagagccgagaacaaaggtaagaacttcaagtacatcagcagcggggatgccaacgccgcatacaacatcgccgtgaagcttctcgaggataaaatcttcgagatcaacaagaaa

SEQ ID NO: 41 - DNA, 3960 bp, Artificial
  synthetic
atgcagcagtaccaggttagcaagacagtcaggttcggacttaccctcaagaactccgagaagaaacacgccactcacctcctcctcaaagaccttgttaacgtgagcgaggagaggatcaaaaacgagatcacaaaggacgacaaaaaccaaagcgagctctccttcttcaacgaggttatcgagaccttggaccttatggataagtatatcaaggactgggagaactgcttctacaggaccgaccagatacagctcaccaaggagtattacaaagtgattgccaagaaggcctgctttgactggttttggaccaacgacagagggatgaagtttcctacttcttccatcatcagcttcaacagcttgaagagctccgacaaatctaagaccagcgacaacctcgacagaaagaagaagatactcgactactggaagggcaacatcttcaaaacccagaaagccatcaaggacgtgctcgatataaccgaggatatccaaaaggcaatcgaggagaagaagagccacagggaaatcaacagggtcaaccacaggaaaatgggtatccacctcatacacctcatcaacgataccttggttcccttgtgcaacgggagtatcttcttcgggaacatctccaagctcgacttctgcgagagcgaaaacgagaagctcattgacttcgccagcaccgagaagcaggacgagaggaagtttctcctttccaagatcaatgaaatcaagcagtacttcgaggacaacggcgggaacgttcccttcgccagggcaaccttgaacagacacactgctaaccagaagcccgacaggtacaatgaggaaatcaaaaagttggtcaacgagctcggcgtcaacagcttggtgaggtctctcaagagcaagaccatcgaggagatcaagacccacttcgaattcgagaataaaaacaagatcaacgagctcaaaaatagctttgtgctttccatcgtcgaaaagattcagctctttaagtataagaccatccccgcatcagtgagattcctcctcgccgactacttcgaagagcagaagctctctaccaaggaagaagctctcaccatttttgaggagatcggcaagccccagaatatcggcttcgactacatccagctcaaggaaaaagacaactttaccctcaagaaataccctctcaagcaagcctttgactacgcctgggagaacctcgctagactcgaccagaatcccaaagccaaccagttcagtgtcgacgagtgcaagagattcttcaaagaggtgttcagtatggaaatggacaatatcaacttcaaaacctacgccctcttgctcgccctcaaagagaagaccaccgcttttgacaagaagggagagggcgccgccaagaacaaaagcgagatcatcgagcagatcaaaggggtcttcgaagaactcgatcagccattcaagattatcgccaacacactcagggaagaggtgatcaaaaaggaggacgagcttaacgttctcaagaggcagtatagggagaccgataggaagatcaagaccttgcaaaatgagatcaaaaagatcaagaaccagatcaagaacctcgaaaacagcaaaaaatactctttccccgaaattataaaatggatcgatctcaccgaacaggaacagctcctcgacaaaaacaagcaagccaaatctaactaccaaaaggccaaaggcgatctcggcctcatcaggggaagtcagaagaccagcatcaatgactacttctacctcaccgacaaggtctacaggaagctcgcccaagatttcggtaagaaaatggcagacctcagggagaaacttctcgacaagaatgacgtgaacaagatcaagtatctctcctacatcgttaaagacaaccaggggtaccagtacacccttctcaaaccactcgaggacaaaaacgccgaaatcatcgagctcaagtccgagcccaatggtgacctcaagctctttgagatcaagagtcttacttccaaaactctcaacaagtttatcaagaataagggggcctacaaggagtttcattcagccgagttcgagcacaagaagatcaaggaagactggaagaattataaatacaactccgatttcatcgttaagctcaagaagtgcttgagtcactccgatatggccaacacccagaactggaaagccttcggctgggacctcgacaagtgcaagagctatgagaccatcgagaaggagatcgaccagaagagttatcagttggtcgagatcaagctcagtaagaccactatcgagaagtgggttaaggagaacaattatctcctcttgcccatcgtcaaccaggatatcactgccgaaaagctcaaggtgaataccaaccaatttactaaggattggcagcacatcttcgagaagaacccaaaccacaggctccatcccgaatttaacatcgcctacaggcagcccaccaaagactacgccaaagagggcgagaagaggtactcaagattccagcttaccgggcagttcatgtacgagtacataccccaggacgccaattatatcagcaggaaggagcagatcaccctctttaatgacaaggaggagcagaagatccaagtggagactttcaacaaccagatcgccaaaatcctcaacgcagaagacttctacgttattggcattgataggggcattacacaactcgccaccctttgtgttctcaacaaaaatggggtgatccagggcggctttgagatattcaccagggaattcgactacaccaacaagcagtggaagcacaccaagctcaaggagaatagaaacatcctcgatatctccaatctcaaagttgagaccacagtgaatggggaaaaggtcctcgtcgacctcagcgaggtcaagacctacctcagggacgagaacggggagcctatgaaaaatgaaaagggagttatcctcactaaggacaacctccaaaagatcaaactcaaacagctcgcctatgataggaaactccagtacaagatgcagcacgagcccgagctcgtgcttagcttcctcgataggcttgagaacaaggagcagatcccaaacctcttggccagcaccaagctcatcagcgcctacaaggaagggaccgcctacgcagacatcgatatcgaacagttctggaatatcttgcagacctttcagaccatagtggacaagtttggcggtatcgaaaatgctaagaagacaatggagttcaggcagtacactgagcttgatgcttcctttgacctcaagaacggcgtcgttgccaacatggtgggggtggtgaagtttatcatggagaaatacaactacaagacatttatagcactcgaagacctcaccttcgccttcggacagtccatcgacggcattaatggggaaaggctcagaagcactaaggaggacaaggaggttgacttcaaggagcaggaaaattcaaccctcgcaggcctcggcacctaccacttcttcgagatgcaactcttgaaaaagctctctaaaacccaaatcgggaacgaaatcaagcactttgtgcccgcttttaggtccaccgagaactacgagaagatcgtcaggaaggacaagaacgtgaaggccaagatcgtgtcctaccccttcgggatcgtctctttcgtcaaccccagaaacacatcaatcagctgtcccaactgcaagaacgcaaacaagagcaacaggatcaagaaagagaatgacaggatcttgtgcaaacacaacatcgagaagaccaagggcaactgcggcttcgacacagccaacttcgacgaaaataagctcagagctgagaataaaggaaaaaacttcaagtatatcagcagcggcgacgctaatgccgcctacaacatcgccgtcaagctcctcgaggacaaaattttcgaaatcaacaagaag

SEQ ID NO: 42 - DNA, 3960 bp, Artificial
  synthetic
atgcagcagtaccaagtttccaagaccgtcagattcggcttgaccctcaagaacagcgagaagaagcacgccacccacctcctcctcaaagatctcgttaacgtttccgaggagaggatcaagaacgaaattacaaaggacgacaagaaccagagcgagctctctttttttaacgaggtcatagagaccctcgacctcatggacaagtacatcaaagactgggaaaactgtttttacaggaccgaccaaatccagttgaccaaggagtactataaggtgatagccaaaaaggcctgctttgactggttctggaccaacgataggggaatgaaattccctacctcatcaatcatatcctttaactccctcaagtcctccgacaagtccaagactagcgacaacctcgacaggaagaagaagatcctcgactattggaaggggaacatcttcaagactcaaaaagccatcaaggacgtcctcgacatcaccgaggacatccagaaggccatagaagagaagaagagccacagagagatcaacagggtcaaccacaggaaaatgggtatccacctcatccaccttataaacgacaccttggtccccctttgcaatggtagcatattctttggcaacatcagcaaactcgacttctgcgagagcgagaatgaaaagcttattgactttgccagcaccgagaaacaggacgaaagaaagttcctcctctccaaaatcaacgagataaagcaatatttcgaggacaacggcggaaacgtccccttcgccagggccaccctcaacaggcacaccgccaatcaaaagcccgacaggtacaacgaggagatcaaaaagttggtgaacgagctcggggtcaactctctcgttaggtccctcaaatccaagaccatcgaggagatcaagacccattttgagtttgagaacaagaataagatcaacgagcttaaaaattccttcgtcctctccatcgtggagaagattcagctcttcaagtataagactatcccagcttccgtcagatttctcctcgcagactactttgaagagcagaagctctccaccaaagaggaggccctcaccatcttcgaagagatcggcaagccacagaacattgggttcgactacatccaactcaaggaaaaggacaacttcaccctcaagaagtatcccctcaagcaagcctttgactatgcttgggagaacctcgccaggctcgatcaaaaccctaaggccaaccagtttagtgtggacgagtgtaagagattcttcaaagaggtctttagcatggaaatggacaacattaacttcaagacatatgccctcctcttggccctcaaggagaagaccacagccttcgacaagaagggcgaaggcgcagccaaaaacaagtccgagatcatcgagcagatcaaaggggtttttgaagagctcgaccagcccttcaaaatcatcgccaacaccctcagggaggaggtgattaagaaggaggacgagctcaatgttctcaagaggcagtacagggagaccgacaggaagatcaagaccctccagaatgagatcaagaagataaagaaccagatcaagaacctcgagaactccaaaaagtatagctttccagagataatcaagtggatcgacctcaccgagcaagagcagctcctcgataaaaacaagcaggccaagagcaactaccagaaggcaaagggggacctcgggctcattagggggagccagaagacctccatcaacgactatttctacctcaccgataaggtgtacaggaagctcgctcaggacttcggaaaaaagatggccgaccttagggagaagctcctcgacaaaaacgacgttaacaagatcaagtacctctcttatatcgtgaaagacaatcaggggtaccaatacaccctcctcaagcccttggaggacaagaacgccgagatcatcgagctcaagtccgagcctaacggcgacctcaagctctttgagatcaaaagtctcacctccaaaacacttaataagttcattaaaaacaaaggggcctataaggagttccacagcgcagagtttgagcacaaaaagatcaaggaggactggaagaactacaagtacaacagcgacttcatagtgaagcttaaaaagtgcctctcccacagcgacatggccaacacccagaactggaaagcattcgggtgggacctcgacaagtgcaaaagctacgagacaattgaaaaggagatcgaccaaaagtcctaccagctcgttgagatcaagttgagcaaaaccaccatcgaaaagtgggttaaggagaataactatcttctcctcccaatcgtcaaccaagacatcaccgcagagaaactcaaagttaacaccaaccaattcactaaggattggcagcacatctttgagaagaaccccaaccacaggctccaccccgagttcaatatcgcatacaggcaacccaccaaagactacgccaaggagggcgagaaaaggtatagcagattccagctcaccggccagttcatgtacgagtacataccccaggacgcaaattatattagcaggaaggaacagatcactctcttcaatgacaaggaagaacagaagatccaagtcgaaacctttaacaaccagatcgcaaagatcttgaacgccgaggacttctatgttatcgggatcgacaggggcattactcagctcgccaccctctgcgtccttaacaaaaatggcgttattcagggcgggttcgagatcttcacaagggagttcgactacaccaacaagcagtggaaacacacaaaattgaaggagaacaggaacattctcgacataagcaaccttaaggtggaaaccacagtgaacggggaaaaggttctcgtcgacctcagcgaagttaagacctacctcagggacgagaatggcgagccaatgaagaacgagaagggagtcatcctcaccaaggacaacctccagaagatcaagctcaagcagctcgcctatgacaggaagctccagtacaagatgcaacacgagcctgaactcgtcttgagcttcttggataggctcgaaaacaaagagcagatccccaacctcctcgcatccaccaagctcatctccgcctacaaagaggggaccgcctatgctgacattgacatcgagcagttttggaacatcttgcagaccttccagaccatcgtggacaagttcggcggcattgaaaatgctaagaagactatggagtttagacagtacaccgagctcgacgccagcttcgacttgaaaaacggggttgtggctaacatggttggcgtggtcaagttcataatggagaagtacaactacaagacatttatcgccctcgaagacctcactttcgccttcggacaaagcatagacggtatcaacggcgagaggcttaggtccaccaaggaggacaaggaggtggacttcaaagagcaggaaaactccaccctcgccgggctcggaacctaccacttcttcgagatgcagctcctcaagaagctctctaagacacagataggcaacgagattaagcactttgtccctgcatttaggtcaactgagaactacgagaagatcgtcaggaaggataagaatgttaaagctaagattgtcagctaccccttcggtatcgtgtccttcgttaaccccagaaacaccagcatctcttgtcccaactgcaagaacgcaaataagagcaacaggatcaagaaggagaatgacaggattctctgcaaacacaacatcgagaagaccaaaggcaactgcggcttcgacactgccaacttcgacgagaacaagctcagggccgagaacaaagggaagaacttcaagtatatcagctcaggcgacgccaacgccgcctataacatcgccgtcaaactccttgaggacaagatctttgaaatcaacaagaag

SEQ ID NO: 43 - DNA, 3960 bp, Artificial
  synthetic
atgcagcagtatcaggtgtccaaaaccgtcaggtttgggctcaccctcaagaactctgagaagaagcatgctacccacctcctcttgaaagacctcgttaatgtgagcgaagagaggatcaaaaacgagatcaccaaagacgacaagaaccaatccgagctctccttttttaacgaagttatagagaccctcgacctcatggacaagtacatcaaggattgggaaaattgcttctacaggacagaccagatacaactcaccaaggagtactacaaggttatcgccaaaaaggcttgtttcgactggttctggaccaacgacagggggatgaagttccccaccagcagcatcatttctttcaactcattgaagagctccgacaagtcaaagacctctgacaacctcgacagaaagaagaagattctcgactactggaagggcaacatcttcaagacccagaaggccatcaaggatgttctcgacatcaccgaggatatccaaaaagccatcgaagagaagaagtcccacagggagatcaacagagttaaccataggaagatgggtatccacctcatccatctcataaatgacactttggtgcccctttgcaacggttctatcttcttcggtaacatatctaaattggacttctgcgaatccgagaacgagaagctcatcgacttcgccagtactgagaagcaggacgagaggaagttcctcctcagcaagatcaacgagatcaagcagtacttcgaggacaacggtgggaacgtccccttcgccagggctacattgaacaggcacaccgccaaccaaaaaccagacagatacaacgaggagatcaaaaagctcgtcaacgagctcggcgtgaactcccttgtgaggtccctcaaaagcaagaccatcgaggagatcaagacccactttgagttcgagaacaaaaacaagatcaacgagttgaagaactccttcgtcctctccatcgtggaaaagatacagcttttcaagtacaaaaccatacccgcctccgtgaggttcctcctcgccgactacttcgaggagcagaagctctcaaccaaagaggaggctttgacaatcttcgaggagatcggcaaaccccagaatatcggctttgattatatccagctcaaagaaaaggataactttaccctcaagaagtaccccctcaaacaggccttcgactacgcctgggagaacttggccaggcttgatcagaaccccaaggccaaccagttcagtgtggacgagtgcaagagattcttcaaggaagtgttcagcatggagatggataacatcaacttcaaaacctacgccctcctcttggccctcaaggagaagacaaccgcatttgacaagaagggcgagggcgccgctaaaaataaaagcgagatcatcgagcagatcaagggggtcttcgaggagctcgatcagcccttcaagatcatagctaacaccctcagggaggaggtgatcaagaaggaggatgagctcaacgtcctcaagaggcaatacagggagacagacaggaagatcaaaaccctccagaacgagatcaagaagatcaaaaaccaaatcaagaacctcgagaacagcaagaagtactccttccctgaaattatcaagtggatagacctcaccgaacaggagcagctcctcgacaagaacaagcaggcaaagtccaactaccagaaggccaagggcgaccttggcctcattagagggtcccagaagaccagcatcaacgactacttctacctcacagacaaagtgtacagaaagctcgcccaggactttgggaagaagatggccgacctcagagagaaactcctcgacaaaaacgacgtcaacaagatcaagtacctttcatacatcgtgaaggacaaccagggctaccagtacacccttcttaagccactcgaggacaagaacgctgaaatcatcgagctcaagtccgagccaaatggagacctcaagcttttcgagatcaagagcctcaccagcaagaccttgaataaattcattaaaaataagggagcctacaaggagttccacagcgccgagttcgagcacaaaaagattaaggaggactggaaaaactacaagtacaactccgacttcatcgttaaactcaaaaaatgcctcagccactccgacatggccaacactcagaactggaaggccttcggctgggacctcgacaaatgcaagagctatgagaccatagagaaggagatcgaccagaagagttaccagcttgtcgagatcaagctttccaagaccaccatcgagaagtgggtgaaggagaacaactatctcctccttcccattgttaatcaagacatcaccgccgaaaagctcaaggttaacaccaaccaattcaccaaggactggcagcacatctttgaaaagaaccccaaccacaggttgcaccccgagttcaacatcgcctacaggcagcccaccaaggactacgcaaaggagggcgagaagaggtacagtagattccagttgactggccaattcatgtacgagtacatcccccaagatgccaactacatcagcaggaaggaacagattaccctcttcaacgacaaggaggagcaaaagatccaagtcgagacattcaacaatcagatcgccaagatcctcaacgccgaagatttctatgttatcggaatagacagggggatcacccagctggccaccctctgcgttctcaacaagaacggtgtgatccagggcggtttcgagattttcacaagagagttcgattacaccaacaagcaatggaagcacacaaaattgaaagagaacaggaatatactcgacatctccaacctcaaagtggagactaccgtcaacggggagaaggtgttggtcgacctctccgaggtgaagacctaccttagagacgaaaatggcgagcccatgaagaacgagaagggggtcatccttaccaaggacaacctccagaaaatcaaactcaagcagctcgcctacgacaggaagctccagtacaagatgcagcatgaacccgagctcgtgctctccttcctcgacagactcgagaacaaggagcagatccccaacctcctcgctagcaccaagctcatcagcgcttacaaggagggcaccgcctacgccgatatcgacatcgaacagttctggaatatcctccagaccttccagaccatcgttgacaaattcgggggcatcgagaacgccaagaagaccatggagttcaggcaatacaccgagcttgacgccagctttgacctcaaaaacggcgtcgtcgccaacatggtcggtgtcgtcaagttcattatggagaagtacaactacaagactttcatcgccctcgaggacctcaccttcgcttttggccagtccattgacgggattaatggcgagaggcttaggtccacaaaggaagacaaagaagtcgacttcaaggagcaggagaactccacactcgccggactcggcacttatcactttttcgaaatgcagttgctcaagaagctctccaaaactcagatagggaacgagatcaagcacttcgtgccagcattcaggtccaccgagaattacgagaaaatcgtcaggaaagacaaaaatgttaaagccaagattgtgagctaccccttcggtatcgtcagcttcgtgaaccctagaaataccagcatatcctgtcccaactgtaagaacgccaacaagtccaacaggatcaagaaagagaacgacaggatcctctgtaagcacaatatcgagaagaccaaggggaactgtggcttcgacacagccaatttcgacgagaacaagctcagggccgagaataagggcaagaacttcaaatacatcagctccggggacgccaacgccgcatacaacatagccgtcaagctcctcgaagacaaaatatttgagattaacaagaag

SEQ ID NO: 44 - DNA, 3960 bp, Artificial
  synthetic
atgcaacagtaccaggtgtccaaaaccgtcaggtttggcctcaccctcaagaacagcgagaaaaaacacgccacccacttgctcttgaaagaccttgtcaacgtttccgaggaaaggatcaagaacgagatcaccaaagacgacaagaaccagagcgagctcagcttcttcaacgaggttatcgagaccctcgacctcatggacaagtacatcaaagactgggagaattgcttttacaggaccgaccagatccagctcaccaaggagtactacaaggtcatagccaagaaagcctgcttcgactggttctggaccaacgacagggggatgaagtttcccaccagctccataataagcttcaactccctcaagtccagcgacaagtccaaaacctccgataatctcgacaggaaaaaaaagattctcgactactggaagggaaacatattcaagacccagaaagccatcaaggatgtgctcgacattaccgaggatatccagaaggccatagaggaaaagaaaagccacagagagatcaatagggtgaaccacaggaaaatggggatccaccttatccacctcattaacgacacactcgttcccctctgcaacggatccatcttcttcggtaacatcagcaagctcgacttctgcgagagcgaaaacgagaagctcatcgacttcgccagcaccgagaagcaagacgagagaaagtttctcctcagcaagatcaacgagattaagcaatacttcgaagacaatgggggcaacgttccctttgccagggccaccctcaacagacacaccgccaaccagaaacccgataggtataatgaggagatcaaaaagctcgttaacgagctcggggtcaactccttggttagaagcttgaagagcaagaccatcgaagagattaagacccacttcgagttcgagaacaagaacaagatcaacgagctcaagaacagcttcgtgttgagcattgtcgagaagatacagctcttcaagtacaaaaccatccccgcaagcgtcagattcctcttggcagactacttcgaagagcagaagctctccacaaaagaggaggctctcaccatcttcgaagagataggaaagccccagaacattgggttcgattacatccagctcaaggagaaagacaacttcaccctcaaaaagtacccactcaagcaggctttcgactacgcctgggagaacctcgccaggctcgaccaaaaccctaaggccaaccagttcagcgttgacgagtgcaagaggttctttaaggaggtgttctccatggaaatggataacattaacttcaagacctacgccttgctcctcgcccttaaggagaagaccaccgccttcgacaagaagggcgaaggcgccgccaagaacaagtccgagatcatcgagcagatcaaaggtgtttttgaggagctcgaccaacccttcaagatcattgccaataccttgagggaggaggtcatcaagaaggaggatgagctcaatgttctcaaaaggcagtacagggagaccgacaggaaaatcaaaacccttcagaacgaaataaagaagatcaagaaccagatcaagaacctcgagaacagcaagaagtacagcttcccagagatcatcaagtggatcgacctcactgaacaagagcagctcttggacaagaacaagcaagccaagtctaactatcagaaggccaagggagacctcgggcttatcagggggtctcagaagacctccataaacgattatttctacctcaccgacaaagtgtacaggaagctcgctcaggatttcggtaaaaagatggccgatttgagggagaaactcctcgacaaaaacgacgttaacaagatcaaatatcttagctacatcgtcaaggacaaccaggggtaccaatacactctcctcaagcccttggaagacaagaatgccgagatcatcgagctcaagagcgagcccaacggtgacctcaagcttttcgagataaagtccttgacctccaagaccctcaacaagttcatcaagaacaaaggtgcttacaaggagttccacagcgccgaattcgagcacaagaaaatcaaagaggactggaagaattacaaatacaacagtgacttcatcgtcaagctcaagaagtgcttgtcccacagcgacatggccaatacccagaactggaaggcattcgggtgggacttggacaagtgcaaaagttacgagaccatcgagaaagaaatagaccagaagtcctaccagcttgtggagatcaaactcagtaagaccaccattgagaagtgggttaaggagaacaattatttgctcttgcccatagtcaaccaggacatcacagccgaaaagctcaaggtcaataccaaccagttcaccaaggactggcagcacatcttcgagaaaaaccccaaccatagactccaccccgagttcaacatcgcctacagacaaccaaccaaggactacgccaaggagggggaaaaaagatactcaaggttccaactcacaggtcaattcatgtacgagtatatcccccaggacgccaactacatcagccggaaggagcagatcaccctcttcaacgataaggaggaacagaagatccaggttgagaccttcaataaccagattgccaaaatactcaacgccgaggacttttatgtcatcgggatagacagggggatcacacagcttgctaccctctgcgttcttaacaagaatggggtcatccagggtgggttcgagatcttcactagggaattcgactacaccaacaaacagtggaagcacaccaagctcaaggagaacaggaatatcttggacatctctaatttgaaggtcgagacaaccgtgaacggtgagaaagtcctcgtcgatctcagcgaggtgaagacctacctcagagacgagaatggcgagcccatgaagaatgagaagggggttatcctcactaaggacaacttgcaaaagattaaactcaagcagctcgcctacgacagaaagctccagtacaaaatgcagcacgaacccgagctcgttctctccttcctcgacaggctcgagaacaaggagcagatccccaacttgctcgctagcaccaagctcatcagcgcctacaaggagggtaccgcctacgccgatatcgacattgaacagttctggaacatcctccagaccttccaaaccatcgtcgacaaattcggagggatcgagaatgccaagaagaccatggagttcaggcagtataccgagctcgacgcttctttcgacctcaaaaacggagtggtggccaacatggtcggcgtggtcaaattcatcatggagaagtacaactataagaccttcatcgccctcgaagacctcactttcgccttcggccaatccattgacggaatcaacggggagaggctcagatctactaaggaggacaaggaagttgactttaaagagcaggagaattcaacactcgcagggttggggacctaccactttttcgagatgcaactcctcaaaaagttgtccaaaacccagatcggcaacgagataaaacacttcgttcccgcctttaggtccaccgagaactacgagaaaatagtcaggaaggacaagaacgtgaaggcaaagatcgtttcctacccctttggcatcgtcagcttcgtcaaccccaggaacacctctatcagctgtcccaactgcaaaaatgccaacaagtccaacaggatcaagaaggagaacgatagaattctctgtaagcacaacatagagaagactaaggggaattgtggattcgataccgctaatttcgacgagaacaagcttagggccgagaacaaggggaagaacttcaagtatatcagctctggcgacgccaacgccgcctacaacatcgccgttaagctcctcgaagacaagattttcgagattaacaagaag

SEQ ID NO: 45 - DNA, 3960 bp, Artificial
  synthetic
atgcagcagtatcaggtttcaaagaccgtcaggttcggactcaccctcaaaaatagcgagaaaaagcacgccacccacttgctcctcaaggatctcgtgaacgtctcagaggaaaggatcaagaatgaaataaccaaggacgacaagaaccagtccgagctcagcttctttaacgaggtgatcgagaccctcgatctcatggataagtacatcaaggattgggagaactgcttttacaggaccgaccagatccagctcaccaaggagtactacaaggttattgctaaaaaggcttgcttcgactggttctggactaacgacagggggatgaagttcccaacctctagcatcatcagtttcaattccctcaaatcctctgacaagtccaagacctccgacaacttggacaggaagaagaaaatcctcgactactggaagggcaacatcttcaaaacccaaaaagccatcaaagacgtgctcgacatcaccgaagacatccagaaagccatcgaagaaaaaaagagccacagggaaatcaacagagtcaatcacaggaagatggggatccatcttatccacctcatcaatgatacccttgtccccctctgcaacggctcaatattcttcggcaacatcagcaagcttgacttctgcgaatcggagaacgaaaagctcatcgactttgccagcaccgagaaacaagatgagaggaaattcctcctctccaaaatcaatgagatcaagcagtacttcgaggataatggcggtaacgtgcccttcgccagggccaccctcaacagacacaccgccaaccagaagcctgataggtacaacgaagaaatcaaaaagctcgttaacgagctcggcgttaactccctcgtcaggagcctcaaatccaagaccatcgaggagatcaagactcacttcgaatttgagaataaaaacaaaatcaacgaactcaagaacagcttcgttctctccattgttgagaagatccaattgtttaagtacaaaaccattcccgcctctgtcaggttcctcttggccgactactttgaggagcagaagctctccaccaaggaggaggcccttaccatcttcgaagagatcggcaagcctcagaacatcggtttcgactacatccagctcaaggagaaggacaatttcaccctcaagaagtacccccttaaacaggcctttgattacgcctgggagaatctcgcaaggctcgaccaaaaccccaaggccaaccagttctccgttgacgagtgcaagaggttttttaaagaggtttttagcatggagatggacaacatcaactttaagacctacgccctcctcctcgcccttaaggaaaagaccacagcctttgacaagaaaggcgagggcgccgccaagaataaatccgaaatcatcgagcagataaaaggggtgttcgaggaactcgatcagccctttaagatcattgccaacaccctcagggaggaagtgataaagaaggaggatgaactcaacgttctcaaaagacagtatagagagaccgacaggaagatcaaaaccctccagaacgagatcaagaaaatcaagaaccagatcaagaacctcgagaactccaagaaatactcttttcccgaaatcatcaagtggatcgaccttaccgagcaagaacaattgctcgacaagaacaaacaggcaaagagtaactatcagaaggctaagggtgacctcgggcttatcagagggtcccagaagacctccatcaacgactacttctacctcaccgacaaggtctataggaagctcgcccaggatttcggcaagaagatggccgaccttagggagaagcttttggataaaaacgacgtcaataagatcaagtacctctcttacattgtgaaagacaaccaggggtaccaatatactctcctcaagcccctcgaggacaaaaacgcagagatcattgaactcaagtccgagcccaacggggacctcaagctcttcgaaatcaagtccctcacctcaaagactctcaataagttcatcaagaacaagggcgcctacaaggagtttcattccgctgagtttgagcataagaagatcaaggaggactggaagaactacaagtacaactcagatttcatcgttaagctcaagaaatgcctctcccatagcgacatggccaatacccaaaactggaaagccttcggatgggacctcgacaagtgcaaaagctacgagaccattgagaaggagatcgaccaaaagagctaccagttggtggagatcaagctcagcaagaccaccatcgagaaatgggtgaaggagaacaactacctcctcctccccatcgttaaccaagatataaccgctgagaagctcaaggttaacaccaaccagttcaccaaggattggcaacatatcttcgagaagaatcccaatcatagactccatcctgagttcaatatcgcctacaggcagcccacaaaagactacgccaaggagggcgagaagaggtactccagattccagctcactggccagttcatgtacgaatacatcccccaggatgccaactatatctccaggaaggaacagatcactctctttaacgataaagaggagcagaagatccaggttgaaacctttaacaaccagattgccaagatcctcaatgctgaggacttttacgtcatcggcatcgacaggggaatcacccagctcgccaccctctgcgttctcaataagaacggcgttatccagggggggttcgagatctttaccagggagttcgattacaccaacaagcagtggaagcacaccaagttgaaggagaataggaatatcctcgacatcagtaacttgaaggtcgaaaccaccgtcaatggcgagaaggtgctcgttgacctcagcgaagttaagacttacctcagggacgagaatggagagcccatgaagaatgagaagggggtgatcctcacaaaagacaacctccagaaaatcaaactcaagcaactcgcctatgacagaaagcttcagtacaagatgcaacacgaaccagagctcgttctcagctttctcgacagacttgagaataaggaacagatccccaacctcctcgccagcaccaagctcatcagcgcctacaaggagggcaccgcctacgccgacatcgatatagagcagttttggaacatcctccagacctttcagacaatcgtcgacaagttcggcggtatcgagaacgccaaaaagaccatggagttcaggcaatataccgagttggatgcaagtttcgatctcaaaaatggcgtcgtcgccaacatggtgggggtcgtgaagttcattatggagaagtacaactacaaaaccttcattgcactcgaggacttgaccttcgccttcgggcagagcatcgacggaataaacggcgagaggcttaggtccaccaaggaggataaggaggttgacttcaaagagcaggaaaactccaccctcgctggcctcggcacataccatttctttgagatgcagctcctcaagaaactctccaaaactcagatagggaacgagatcaagcacttcgtgcccgcctttaggtctaccgagaattatgagaagatcgtgaggaaagacaaaaacgtgaaagccaaaattgttagttacccctttggcatcgtttccttcgtcaaccccaggaacaccagtatttcctgcccaaactgcaagaacgccaacaagagcaacaggattaagaaagagaacgacaggatcctctgcaagcacaatatcgagaagacaaagggtaactgtggcttcgacaccgccaactttgatgagaacaagctcagggctgagaacaagggcaaaaattttaaatatatctccagcggagacgcaaacgcagcctacaacatagccgtcaaactcctcgaggacaagatcttcgagatcaacaagaag

SEQ ID NO: 46 - DNA, 3960 bp, Artificial
  synthetic
atgcagcagtaccaggtgagcaagaccgtgaggttcggtctcaccctcaagaacagcgagaagaaacacgccacccacctcctcctcaaggacctcgtcaacgtgagcgaggagaggatcaagaacgagatcaccaaagacgataagaatcagagcgaactcagcttcttcaacgaagtcattgaaaccctcgacctcatggataaatacatcaaggattgggagaattgtttctataggaccgaccaaatacaacttaccaaggagtactacaaggtgatcgccaagaaggcctgcttcgactggttttggaccaacgataggggcatgaagttccccaccagctccatcatcagcttcaacagcctcaagagtagtgacaagagcaagaccagcgataacttggacagaaagaagaagatcctcgattactggaaaggtaatatcttcaagactcagaaagccatcaaggacgttctcgacatcaccgaggacatccagaaggcaattgaagagaagaagtcacacagggagatcaacagggtcaaccataggaaaatgggcatccacctcattcaccttatcaacgacaccctcgtgcccctctgcaacgggagcatctttttcggcaacataagcaagttggatttctgcgagagcgaaaatgagaagctcatcgactttgcaagcaccgagaagcaagacgagagaaagttcctcctctccaagatcaacgagatcaaacaatatttcgaagataacgggggcaacgttcccttcgcaagagcaaccctcaacaggcacaccgctaaccaaaagcccgacaggtacaacgaagaaatcaaaaagctcgtgaacgagctcggggttaatagcctcgttagaagcctcaagtccaaaacaatcgaagaaatcaagactcactttgaattcgagaataaaaacaaaattaacgagttgaagaacagcttcgttttgtccatcgtggagaagatccagctcttcaagtacaaaaccatccccgcttccgtcagattcctccttgctgactatttcgaagaacagaaattgtccactaaggaggaggccctcaccatcttcgaggagatcggcaaaccccagaacatcggttttgactatatccaattgaaggaaaaggacaatttcacccttaagaagtaccccctcaagcaggcattcgattacgcctgggaaaatctcgccagactcgatcagaaccccaaggccaaccagttctccgtcgacgagtgcaagagattctttaaggaggtctttagcatggagatggataatataaacttcaaaacctacgccctcttgctcgccctcaaagagaaaacaaccgcctttgacaagaaaggcgagggtgccgccaagaacaagtctgagattatcgagcagatcaagggggtcttcgaagagctcgaccaacccttcaagattatcgccaatacccttagagaagaggttatcaagaaagaagacgagctcaacgtgctcaaaagacagtatagggagacagacaggaaaatcaagaccctccagaacgagatcaagaagatcaagaaccagataaagaacctcgaaaattcaaagaaatattcctttcccgagattataaagtggatcgacctcacagagcaggagcagctcctcgacaagaataagcaggccaaatctaactaccagaaggccaagggggacttgggtcttatcagggggagtcaaaagaccagcatcaacgactacttctacctcaccgacaaggtgtacagaaaactcgcccaggactttggtaagaaaatggccgacctcagggaaaagcttttggacaaaaacgatgtcaacaagattaagtacctctcttacatcgtgaaggacaaccaggggtatcagtataccctccttaaaccactcgaggacaagaacgccgagataatcgagctcaagagcgagcccaatggcgacctcaaactcttcgaaattaagtccctcacctccaagaccttgaacaaattcatcaagaacaagggggcctacaaggagtttcattccgccgagtttgagcacaagaagatcaaagaggattggaagaactacaagtacaatagcgatttcatcgtcaaactcaagaagtgcctcagccattcagacatggccaatacacaaaactggaaggcattcggctgggacctcgataagtgcaagtcctatgagaccatcgagaaagaaatcgatcaaaagtcataccagctcgtcgagatcaagctctccaaaacaacaatagagaaatgggtcaaggaaaacaattacctcttgctccccatcgtgaaccaagacatcaccgctgagaagctcaaggtgaataccaaccaatttaccaaagactggcagcacatcttcgagaagaaccccaaccacaggctccaccccgagttcaacatcgcctacagacagcccaccaaggactacgcaaaggaaggggaaaaaagatacagtagattccagctcaccggccagtttatgtatgagtacatcccccaagacgccaactacatcagcagaaaggagcagattaccctctttaacgacaaggaggagcaaaagatccaggtcgaaaccttcaacaaccaaatagctaagatcctcaatgccgaggacttctatgtcataggaatcgataggggtatcacccaactcgcaaccctctgtgttctcaacaagaacggggtgatccaagggggattcgagatattcaccagggagttcgattacactaacaaacagtggaagcacacaaaactcaaagagaacaggaatatcctcgacatctccaatcttaaggttgaaaccaccgtgaacggggagaaggttctcgttgacctcagcgaggtcaagacctatttgagagacgagaacggggagcctatgaagaatgaaaagggggtgatccttaccaaggacaaccttcagaagatcaagctcaaacagctcgcctacgacaggaagctccagtataagatgcaacacgagccagagttggtcctctcattcctcgacagattggagaacaaggaacagatccccaaccttctcgccagcaccaagttgatctccgcttataaggaggggaccgcctacgccgacattgatatcgaacaattttggaatatactccaaacctttcagactatagttgacaaattcggtggcatcgagaatgccaagaagacaatggaatttaggcagtacactgagctcgatgcaagctttgacttgaagaacggtgttgtcgctaacatggtcggggtcgtcaaattcatcatggagaagtataactataagacctttatcgcattggaggatctcacctttgccttcggccagagtatcgacgggatcaatggcgagaggctcagaagtacaaaggaagataaggaggttgacttcaaagagcaggagaattctaccctcgccggccttggtacctaccacttcttcgagatgcagctcctcaagaagctcagcaagacccaaattggcaatgagatcaaacacttcgttcccgccttcaggagcaccgagaactatgagaaaattgtgaggaaggacaagaatgtcaaggccaagatcgttagttatcccttcgggatcgtgtccttcgtcaacccaaggaacaccagcatctcatgcccaaattgcaagaacgccaacaaatcaaataggatcaagaaggagaacgacaggatcctctgcaagcacaacattgaaaaaaccaaggggaactgcgggttcgacaccgctaacttcgacgagaataaactcagggcagaaaataagggcaagaatttcaagtacatcagctctggagatgccaacgccgcctacaacattgccgttaagctccttgaggacaagatcttcgagatcaacaaaaaa

SEQ ID NO: 47 - DNA, 3960 bp, Artificial
  synthetic
atgcagcagtatcaggtgtcaaaaactgtgaggttcgggctcaccttgaagaacagcgagaagaagcacgccacccaccttctcctcaaggacctcgtgaacgtgagcgaggaaagaatcaagaatgagataaccaaggacgacaagaaccaatctgaactctcattcttcaacgaggtcatcgagaccctcgacctcatggacaagtacattaaggactgggagaactgcttctataggaccgatcagatccagctcaccaaggagtattataaggtgatcgccaagaaggcttgcttcgactggttctggaccaacgataggggcatgaagttccccaccagctctattattagtttcaatagtttgaaaagcagcgacaagagcaagacctccgacaaccttgatagaaagaagaagatcctcgactactggaaggggaacatattcaagactcaaaaggctatcaaagacgtcctcgatatcaccgaggacatccagaaggccatcgaggagaagaagtcccatagggaaatcaacagggttaaccacaggaagatggggatccatctcatccacctcataaatgataccctcgtgccactctgtaacggctccatctttttcggaaacatcagcaagttggatttctgcgagtccgagaacgagaagcttatcgacttcgcctctacagaaaagcaagacgaaaggaagttcctcttgagcaaaatcaatgagataaaacagtacttcgaggacaacggcgggaatgtcccattcgccagggccaccctcaacaggcacaccgccaatcagaagcccgacaggtacaacgaagagatcaagaagctcgttaacgagttgggcgtcaacagccttgtgagatccctcaagtccaaaaccatcgaggaaatcaagacccacttcgagttcgagaataaaaataaaatcaacgaactcaagaacagctttgtcctctccatcgtcgagaagatacagctctttaagtataagaccatccccgcctcagtgaggttcctcctcgccgactactttgaggagcagaagctcagtaccaaggaagaagccctcaccatctttgaggaaatcggcaagccccagaacattggctttgactacatccagctcaaggagaaagacaatttcaccctcaagaagtaccccctcaagcaggccttcgactacgcctgggagaacctcgctagattggaccaaaaccccaaggccaaccaattctccgtggacgagtgcaagaggttcttcaaggaggttttctcaatggagatggacaatatcaactttaagacctacgccctcctcctcgccttgaaagagaagaccaccgccttcgataagaagggggagggcgccgccaaaaacaagtccgagatcatcgagcaaatcaagggcgtcttcgaagagctcgaccagcctttcaaaatcattgccaacaccctcagggaggaagtgatcaaaaaagaggacgagctcaacgttctcaagaggcagtacagggagaccgacaggaagatcaaaaccctccagaatgagatcaaaaagatcaagaaccagataaaaaacctcgagaactccaagaaatattcctttcccgagataattaagtggattgaccttaccgagcaggagcagctcctcgataagaacaaacaggccaaatccaactaccagaaggccaaaggggatctcgggcttatcaggggcagccagaagaccagcatcaacgactatttttacctcaccgacaaggtctacaggaagctcgcccaggactttggcaagaagatggccgatctcagggagaagctcctcgacaaaaacgacgttaacaagatcaagtacctctcctacatcgtgaaagacaaccaaggctaccaatataccctcctcaagcctctcgaagacaagaacgcagagatcatcgagttgaaatcagagcccaatggagacttgaagctcttcgagatcaagtctctcacctctaagaccctcaacaagttcataaagaataagggggcctacaaggaattccactccgctgagttcgagcataagaagatcaaagaggattggaagaactacaagtacaacagcgacttcatcgtcaaactcaagaaatgcctcagtcattctgatatggccaacactcaaaactggaaggcattcggctgggacctcgacaagtgcaagagctacgagactatagaaaaagagatcgaccagaaatcttatcagctcgttgagatcaagctctccaagaccaccatcgagaaatgggtcaaggaaaacaactacctcctcctccccatcgtcaatcaggacatcaccgccgagaagcttaaagtcaacaccaaccaatttaccaaagactggcagcacatcttcgagaagaatcccaaccacaggctccaccctgagttcaacatcgcatataggcaacccacaaaggactatgctaaggagggagaaaaaaggtactccaggtttcagctcacaggccagttcatgtacgagtatattccccaagacgctaactacatctccaggaaggaacagatcaccctctttaacgacaaggaggagcagaagatccaagttgagaccttcaataaccagatcgccaagatcttgaacgccgaggacttctacgtgattgggattgacagggggatcacacagctcgccacactctgcgtcctcaacaaaaatggtgtcattcaaggggggttcgagatcttcaccagagagttcgattacaccaataagcaatggaagcacacaaagcttaaggagaacaggaacatccttgacattagcaacctcaaggtggagaccacagtgaacggtgagaaggtcctcgtcgatctttccgaagtcaagacctatcttagagacgagaatggggaacctatgaagaacgaaaaaggggtgatactcactaaggacaacctccagaagataaagctcaagcaacttgcctatgacaggaaactccagtacaagatgcaacatgagcccgagctcgtcctcagtttcctcgacaggctcgagaacaaggaacagatccccaacctcctcgctagcaccaagctcataagcgcctacaaggaggggaccgcttacgccgacatcgacatcgagcaattctggaacatcctccagaccttccagaccatcgtggacaagttcgggggcatcgagaatgccaagaaaaccatggaattcagacagtacaccgaacttgacgcttccttcgacctcaaaaatggcgttgtggccaacatggtgggggtcgtgaagttcatcatggagaaatacaactacaagaccttcatcgccctcgaggacctcacctttgccttcggtcagtccattgatgggataaacggggagaggttgagaagcaccaaggaagacaaggaggtcgactttaaggagcaggagaattctacattggccggccttggcacctatcatttttttgagatgcaactcctcaagaaactctccaaaacccagatcggaaatgagatcaagcacttcgtgcccgcctttagaagcaccgagaattacgagaagatcgtcagaaaggataagaacgtcaaggcaaaaatcgtctcctaccccttcggaatcgtttccttcgtcaaccccaggaacaccagcatttcctgtcccaactgcaagaacgccaataagtcaaacaggattaagaaggaaaacgataggattctctgcaagcacaacatcgagaagactaagggaaattgcgggtttgacaccgccaactttgatgagaacaaactcagagccgagaataaaggcaagaacttcaagtacatctccagcggcgatgccaacgccgcctacaacattgccgttaaactcctcgaggacaaaatctttgagataaacaaaaag

SEQ ID NO: 48 - DNA, 3960 bp, Artificial
  synthetic
atgcagcaataccaggtttccaagaccgtgagatttggcctcacactcaaaaattctgagaagaagcacgctacccaccttcttctcaaggatctcgtgaacgtttccgaggagaggatcaaaaacgagatcaccaaagacgacaagaaccaatccgagctctccttcttcaacgaggttatcgagacactcgatctcatggacaagtatatcaaggactgggaaaattgcttctacaggaccgaccagatccagctcactaaggaatactataaggtgatagccaagaaggcctgcttcgattggttttggaccaatgataggggtatgaaattccccacctccagcatcatcagcttcaatagcctcaagagcagcgacaagagcaagaccagcgacaacctcgataggaaaaagaagatactcgactactggaagggcaacattttcaagactcaaaaggccattaaggatgtgcttgatatcacagaagacatacaaaaagctatcgaggagaaaaaatcccacagggagatcaacagagtgaaccacaggaagatgggaatccacctcatccacctcatcaatgacacacttgtgcccctctgcaacgggtctattttcttcggcaacatatccaagctcgacttttgcgaaagcgaaaacgagaagctcatcgactttgccagcaccgaaaagcaggacgagaggaagttcctcctttccaaaatcaacgagataaagcaatacttcgaggacaacgggggcaacgtgccctttgccagggccaccctcaataggcacactgccaaccaaaagcccgacaggtacaacgaggagatcaagaagctcgttaacgagctcggagtcaactccctcgtgaggtcactcaaaagcaagacaatcgaagagatcaagacccactttgaatttgagaacaagaataagatcaacgaactcaaaaacagtttcgttctctccatagtcgaaaagatccagctcttcaagtacaagaccatccctgccagtgtcaggttccttctcgccgactacttcgaggagcagaaactcagcactaaggaagaggccctcaccatcttcgaagaaatcggtaagccccagaacataggctttgactacatccaactcaaggagaaagacaacttcaccctcaaaaagtatcccctcaagcaggccttcgactatgcctgggagaacctcgccaggctcgatcaaaaccccaaggccaaccagttcagcgttgacgagtgcaaaaggttcttcaaagaggtttttagcatggaaatggacaatataaacttcaaaacctacgccctcctcctcgccctcaaggaaaagaccaccgcattcgacaagaaaggagagggcgccgccaagaataagagtgaaattattgaacagatcaagggagttttcgaggaactcgaccaacctttcaagattatcgccaataccctcagggaggaagtgatcaagaaggaggacgagctcaacgtcctcaaaaggcagtacagggagacagacaggaagatcaagaccctccaaaacgagatcaagaagatcaagaaccagattaagaacctcgagaactcaaagaagtactccttccccgagatcataaaatggatcgacctcaccgagcaggagcagcttctcgacaagaacaagcaggccaagagcaattatcagaaggccaaaggcgacctcgggctcatcaggggaagtcagaagacctccatcaacgactacttctacctcaccgacaaggtgtacaggaaactcgcccaggacttcgggaagaaaatggccgacttgagagagaagctcctcgacaagaatgacgtgaataagattaaatatttgagctacatcgtgaaagacaaccagggatatcagtataccctcttgaagcccctcgaggacaagaacgctgagatcatcgagctcaagtccgagccaaatggtgaccttaagcttttcgagatcaagtcacttacaagtaaaacccttaacaaatttatcaagaataagggcgcctacaaggagttccacagcgccgagtttgagcacaagaagatcaaagaggactggaagaactacaaatacaactccgatttcatcgtgaagctcaaaaaatgcctcagccacagcgacatggctaacacccagaactggaaagctttcgggtgggacttggataagtgcaaatcctacgagaccatcgaaaaggagatcgaccagaaaagctaccagctagtggaaatcaagcttagtaagaccaccatagaaaagtgggtcaaggagaataactatctcctcctccccatagttaaccaagacatcaccgccgagaagctcaaggtgaacaccaatcaattcaccaaggattggcagcacattttcgagaagaaccccaaccacaggctccatcccgagttcaacatcgcctacagacaacccactaaagactacgccaaggagggtgagaagagatacagcaggtttcagcttactggtcagtttatgtatgagtacatcccccaggacgccaactacatctcaaggaaagagcagattaccctctttaacgacaaggaggagcaaaagatccaggtggagaccttcaacaaccagatcgctaaaatcctcaacgccgaggacttttatgttatcggcatcgataggggtattacccaactcgctaccctctgcgttctcaacaagaacggtgtcatccagggcgggtttgagatcttcactagggagttcgactataccaacaaacagtggaaacacaccaagctcaaggaaaatagaaacatcctcgacatcagcaacctcaaggtggagacaaccgtgaacggcgagaaggtgctcgtcgacctcagtgaagtgaagacctacttgagggacgaaaacggcgagcccatgaagaacgagaaaggcgtgatcctcacaaaggacaacctccagaagatcaagctcaagcagctcgcctacgacaggaagcttcagtacaagatgcagcacgagccagaactcgtgctctcctttctcgataggctcgagaacaaagagcagatccccaatctcctcgcctccaccaaactcatatccgcctacaaggaggggacagcttacgctgacatcgatatagaacaattctggaacatcctccagaccttccagaccatcgtggacaagttcggggggatcgagaatgccaagaaaaccatggagtttaggcagtataccgaacttgacgccagcttcgacttgaagaatggggtcgtggccaatatggttggggtcgtcaagttcatcatggaaaaatataactacaaaaccttcatcgccctcgaagaccttaccttcgccttcggccagtccatcgatggcatcaacggcgagagactccgatccacaaaagaagacaaggaggtggacttcaaggagcaagagaattccactcttgccggcctcgggacctaccactttttcgagatgcagctcctcaagaagctctccaagacccaaatcgggaacgagataaagcactttgtccctgccttcaggtcaaccgagaactacgagaaaatcgtcaggaaagacaaaaacgtcaaggccaagatcgtttcctaccccttcggcatcgttagtttcgttaaccccaggaacaccagcatctcctgccccaactgcaagaacgccaataagagcaacaggatcaaaaaagaaaacgacaggatcctttgtaaacataatatcgagaagaccaaggggaactgcgggtttgacaccgccaacttcgatgagaacaagctcagggcagagaataaagggaagaatttcaagtacatctccagcggggacgccaacgccgcctacaatattgccgtgaagctcttggaggacaagatcttcgaaatcaataagaag

SEQ ID NO: 49 - protein, 1307 aa, Unknown
  Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 50 - DNA, 3921 bp, Artificial
  synthetic
atgacacagtttgaaggatttacaaatctttaccaggtgtcaaaaactttaaggtttgaattaattccccagggaaaaactctgaaacacatacaagagcagggttttattgaagaggacaaggcacgaaacgatcactacaaagaattaaagcccattattgatcgtatctataaaacctatgctgaccagtgcctgcaattggttcaactagattgggaaaacctgagtgccgctattgattcttacaggaaagagaaaacagaagaaaccagaaatgctcttatagaagagcaagctacataccggaacgcgattcatgactatttcatagggaggaccgacaatcttacggatgcaattaacaagcgtcacgctgaaatatacaaaggtctcttcaaggctgagctcttcaacggtaaggtcttgaaacagttaggaaccgtgacaactacggaacacgaaaatgcattgttgagatcctttgataaatttactacttacttcagtgggttttatgaaaacaggaaaaatgttttttccgccgaggacatttctacggcgattcctcatagaatcgtacaggacaacttccccaagtttaaagagaactgtcacatctttactaggcttattaccgctgttccatcattaagggagcattttgaaaacgtgaagaaagcaatcggaatttttgtttccacatccattgaagaggttttttcttttccattttataaccagcttcttacccagacacagattgatctttacaatcaacttcttggtggaataagcagggaggctggaactgagaagattaaaggtctcaacgaagttttgaacctcgcaattcaaaaaaacgacgaaactgctcatattatagcgtccctcccgcatcgattcattcctttgtttaaacaaattctttctgatcgtaacactctttcttttattctagaggaatttaagtcagacgaggaggtaatacaaagcttctgtaagtataagactttgctaagaaatgaaaacgttttggagactgcagaagctctttttaatgaattaaattccatagacttgactcatattttcatctctcataagaaattagaaaccattagtagtgccctctgtgatcactgggataccttgcgtaatgctctttatgagagaagaatttcggaactgacaggtaagataactaagtcagccaaggaaaaggttcaaaggtccttgaagcacgaggatattaacctgcaggagatcatttctgctgctgggaaggaacttagcgaggcttttaagcagaagacatccgagatcctctcccatgcccacgcagcacttgatcaacctttgcctactactcttaaaaaacaggaggaaaaagaaatcttgaaatctcaacttgatagtttacttgggctttatcacttgctcgattggttcgctgtggatgagtccaatgaggtggaccctgaattctcggccaggctgacaggcattaagcttgagatggagccatctttgtcattttacaataaggcccggaattacgccactaagaaaccttattccgtggagaaattcaaacttaacttccagatgcctacattggctagcggatgggacgttaataaagaaaaaaataacggagcaattctattcgtaaagaacgggctctactatctcggaattatgccaaaacaaaaggggcgctataaggctcttagtttcgagccaaccgaaaagacatccgagggctttgataaaatgtactacgattatttcccagatgcagctaaaatgattccaaaatgctctactcaattaaaggccgtcacagctcactttcagactcatacaacgcctattcttctctctaataacttcatcgaaccactggagattaccaaggaaatctatgatttaaacaaccccgaaaaagaacccaaaaagtttcagactgcgtatgctaaaaaaactggagatcagaagggttaccgcgaagctctctgtaaatggatagattttactcgtgatttccttagcaaatatactaaaaccacctccatagatttgtcctccctaagacctagcagtcaatacaaagatcttggggagtactatgcagagctaaatccactgttgtaccatatctcttttcaaagaatcgcagagaaagaaattatggatgccgttgaaactggaaagctatatttattccagatatacaataaggactttgcgaagggtcatcatgggaaaccaaaccttcatactctatattggacaggtctcttttcccccgaaaatttagctaaaacatcgattaagctcaatggccaggccgaactgttctataggccgaaaagtaggatgaaaagaatggctcataggctcggagaaaagatgcttaacaagaagcttaaagaccagaaaactcccattccagacacactctaccaggagttgtatgattacgttaatcacaggttaagccacgacctttctgatgaggcaagagcccttctcccaaacgtgatcaccaaggaagtctcccacgagattattaaggatagacgatttacctccgacaaattctttttccacgtgcctattaccctgaactatcaggctgcaaattcacctagtaaattcaatcaacgagtaaacgcctacttgaaggagcatcccgaaactcctataattggtattgatcgtggagaacgaaatcttatatatattactgttattgattcaactggtaaaatacttgagcagaggtcattaaataccatacaacagtttgattaccagaagaaattagataacagagaaaaagagagggtcgctgcaagacaagcatggtccgtggttgggacaattaaagaccttaaacaagggtacctatcacaggtgatccacgaaattgtagatctgatgattcactaccaggccgtggttgttttagaaaacttaaatttcggctttaagtccaaaagaacagggatcgccgaaaaggcagtttatcaacaatttgaaaaaatgctcattgataagttaaattgcttggtgctcaaggattatccggctgaaaaggttggaggcgtacttaatccataccaactgacggaccagtttaccagcttcgctaagatgggtactcagagtggatttttgttctatgttcccgcaccgtacacttcaaagatagatcccctaacgggtttcgttgatccattcgtgtggaagacgataaagaaccatgagagccgcaaacatttcctagaaggatttgacttcctgcactatgacgtaaaaaccggggactttatcctccactttaagatgaatcggaatctgtcctttcaaagaggtctgccaggatttatgcccgcttgggatatagtgttcgaaaagaacgaaactcagtttgacgctaaggggacacctttcatagctgggaagcgaatagttcctgtgatcgaaaatcaccgtttcaccggtcgctatagggacctttaccctgctaacgagctgatcgcgctccttgaagagaaaggaatcgttttcagagatggtagtaacattcttcctaaactacttgaaaacgacgactcacacgccattgacactatggtcgcactcattaggtctgtgttgcagatgcgcaactctaacgcggcaactggtgaggactatattaatagcccagttagagatttaaacggcgtatgttttgactctcgcttccaaaatcctgagtggcccatggacgctgacgctaacggcgcttatcacattgcattgaagggacaattgttactaaaccatctcaaggaatccaaagatcttaagttgcaaaatggtatttctaatcaagactggttggcctatatacaggagcttaggaat

SEQ ID NO: 51 - DNA, 3921 bp, Artificial
  synthetic
atgacccagttcgagggatttaccaatctctatcaggttagcaaaaccctcaggttcgagctcatccctcagggcaagacactcaagcatatccaggagcagggtttcatcgaggaggacaaggccaggaatgaccactacaaggagctcaagccaatcatcgacaggatttacaagacctacgccgaccagtgcctccagctcgtgcagctcgactgggagaacctctccgccgccatcgacagctacagaaaggagaagaccgaggaaaccagaaacgccctcatcgaagagcaagctacatacaggaatgcaatccatgactactttatcgggagaaccgacaacctcaccgatgcaataaacaaaaggcacgctgagatctacaaaggcctcttcaaggccgagctcttcaacggtaaggtgctcaagcagctcggcaccgtcaccaccaccgagcacgagaacgccctcctcaggagcttcgacaagttcactacctatttcagcggcttctacgagaacaggaagaacgtcttctccgccgaagacatctctaccgccatccctcacaggattgtgcaagacaacttccctaagtttaaggaaaactgtcacatcttcaccaggctcatcaccgccgttcccagcctcagggagcacttcgaaaacgtgaagaaggccatcgggatcttcgtgtccacctccatcgaggaggtgttctccttccccttttacaatcagctcctcacccagacccagatcgacctctacaaccagctcctcggtggcatcagcagggaggccggcaccgagaagatcaaggggttgaacgaggtgcttaacctcgccatccagaaaaacgacgagaccgcacatatcatcgcctctctcccccacaggttcatacccctcttcaaacagatcctctcagacaggaacacactcagctttatcttggaggaatttaagtccgacgaggaggtcatacagagcttctgcaaatataagaccctcttgaggaatgagaacgttctcgagaccgccgaggcactcttcaacgaactcaacagcatcgatctcactcacatctttatatcacacaaaaaactcgagaccatctcatccgcattgtgtgaccactgggataccttgagaaacgccttgtacgagaggaggatctccgagctcaccgggaagataaccaagtccgccaaggagaaggttcagaggtccctcaagcacgaggacataaacctccaggagatcatctccgccgccggaaaggaattgtccgaggccttcaagcagaaaacttcagagatcctcagccacgcccacgccgctctcgatcagcccctccccacaaccctcaagaagcaagaggaaaaggaaatcttgaagagccaattggactccctcctcggcttgtaccaccttcttgactggttcgctgtcgacgagtccaatgaagtcgaccccgaattcagcgctaggctcactggcataaagctcgagatggagccttccctctccttctacaataaggcaaggaactatgctaccaagaagccctacagcgtcgagaaattcaagctcaactttcagatgcccaccctcgcttctggctgggacgtcaacaaggagaaaaacaacggcgccatcttgttcgtgaagaacggtctttactacctcggtatcatgccaaagcaaaaggggaggtacaaggccctctccttcgagcccacagaaaagacctccgagggcttcgacaaaatgtactacgactacttccccgacgccgccaagatgattcccaagtgtagcacccagctcaaggccgtgaccgcccacttccagacccataccacccccatattgttgtccaacaacttcatagagcccttggaaatcaccaaagaaatatacgacctcaacaaccccgagaaggaacccaagaagttccagaccgcctacgccaaaaagaccggggaccagaagggatacagagaggccttgtgcaagtggattgacttcaccagggatttcttgtcaaagtataccaagacaaccagcatcgacctcagcagtctcagaccctctagccaatataaggacctcggcgagtactacgccgagctcaaccccctcctctaccacatcagcttccaaaggatcgccgagaaggaaattatggacgctgtggagaccggcaagctctatctcttccaaatctacaacaaagatttcgctaagggccaccacgggaagcccaaccttcacaccctctactggaccggtctcttcagccccgaaaacctcgccaagaccagtatcaagctcaacggccaggccgagctcttctataggcccaagagcaggatgaagaggatggcccacaggctcggtgagaagatgctcaacaagaaactcaaagaccagaagacccccatcccagacaccctctatcaagagctctacgactacgtcaaccacaggctcagtcacgatctctccgatgaggccagagcccttcttcccaacgtcatcaccaaggaggtgagccacgagatcatcaaggacaggagattcaccagcgacaagttctttttccacgtccccatcaccctcaactaccaagccgccaatagccccagcaagttcaaccagagggtgaacgcatacctcaaggagcaccccgagacccctatcatcggcatcgacagaggcgaaaggaacctcatctacatcactgtgatcgacagcaccggtaagatcctcgagcagaggagcctcaacaccatccaacagttcgattaccaaaagaagcttgacaatagggagaaagagagggtcgccgccaggcaggcctggtccgttgtgggtaccataaaggatcttaaacagggctaccttagccaggtcatccacgaaatcgtggacttgatgatacactaccaggccgtcgttgtgctcgaaaacctcaacttcggattcaagagcaagaggaccggtatagccgagaaagctgtctaccaacagttcgagaagatgctcatcgacaagctcaactgcctcgtgcttaaggactaccccgccgaaaaggttggcggtgtgcttaatccctaccaactcaccgatcagtttacctctttcgccaagatggggacccaatctggtttcctcttctatgtgcccgccccatacacttctaagatcgacccccttaccgggttcgtggacccattcgtgtggaaaaccattaagaaccatgagtccagaaagcatttcctcgagggcttcgattttctccactacgatgtcaagactggcgacttcatcctccactttaagatgaacaggaatctcagcttccaaaggggtctccccggattcatgcccgcctgggacatcgtctttgagaagaacgagacccagttcgacgccaaggggacccccttcatcgcagggaaaagaatcgttcccgtgatagaaaaccacaggttcaccgggaggtacagggacctctatcccgccaatgagctcatcgccctcctcgaagagaagggtatagtgttcagggacgggtccaacatcctccccaagctcctcgaaaatgacgactcacacgccatcgacactatggttgccctcatcaggagtgtcctccaaatgaggaactccaacgctgccaccggggaggactatatcaatagtcccgtgagagacctcaatggggtctgcttcgactcaagattccagaatcccgagtggccaatggatgccgacgcaaacggcgcttaccacatcgctcttaagggacagctcctcttgaaccatttgaaagaatccaaagatctcaagctccagaacggcatctccaaccaagactggctcgcctatatccaggagctcaggaac

SEQ ID NO: 52 - DNA, 3921 bp, Artificial
  synthetic
atgacccagttcgaaggcttcaccaacctctaccaggttagcaagaccctcagattcgagctcattcctcaggggaaaactttgaaacatatccaagagcaggggtttatagaagaggacaaggccagaaacgatcactacaaggagcttaagcccatcatcgacagaatctacaagacttacgctgatcagtgcctccagctcgtgcaactcgactgggagaacctctcagcagccatcgattcctataggaaggagaagaccgaagagaccaggaacgccctcatcgaggagcaggccacctacaggaacgccatccacgattactttatcggcagaaccgacaacttgaccgacgctattaataagaggcacgccgagatctataaggggctcttcaaggccgagctcttcaacggcaaggttctcaaacagctcggcaccgtcaccaccaccgagcacgagaacgctctcttgagaagcttcgacaagtttacaacctatttctccggcttctacgagaatagaaaaaatgtgttcagcgccgaagacatcagcaccgccatcccccacagaattgtgcaggacaacttccccaagttcaaggagaactgccacatcttcactaggctcataaccgccgtgccctccttgagggagcactttgaaaacgttaagaaggcaattggcatcttcgtgtcaacctcgatcgaggaggtcttcagctttcccttctacaaccagctcctcacccagacccagatagacctctacaaccaactcctcggtgggatctccagggaagccgggaccgagaagatcaaggggctcaacgaagtccttaacctcgccatccagaaaaacgacgagacagcccacattatcgcctccctcccccacaggtttatccccctcttcaagcagattctcagcgatagaaacaccctctcctttatcctcgaggagtttaagagcgacgaagaagttatacagtcattttgtaagtacaagaccctcctcaggaatgagaacgtgctcgagaccgccgaagcacttttcaatgagctcaacagcatagacctcacccatatatttatcagccacaaaaagctcgagaccatcagctccgccttgtgcgaccactgggataccctcaggaacgcactctacgagaggaggatcagtgagttgaccggcaaaatcaccaagtccgcaaaagagaaagtccagagaagcctcaaacacgaggacataaacctccaggagatcatctccgccgccggcaaagagctctctgaggcattcaagcaaaagaccagtgagatcctttcccacgcccatgccgctctcgaccagcccctccccaccaccctcaagaagcaagaggagaaggagatcctcaagagccaattggacagcctcctcgggctctatcacctcttggactggttcgccgttgatgagagcaacgaggttgaccccgagttctccgccagactcaccggcatcaaactcgagatggaaccctccctcagcttctacaataaagccaggaactacgccaccaagaagccctactccgtggagaagttcaagctcaacttccaaatgcccaccctcgcatccggctgggacgtcaacaaggagaagaacaatggggctatcctcttcgtgaaaaacgggctctactaccttgggatcatgcccaaacagaagggaagatataaagccctctcattcgaacctaccgagaaaacctccgaggggtttgacaagatgtattacgattactttcccgacgccgctaagatgatcccaaaatgcagcacccagttgaaggctgtgacagcccatttccagacccacaccaccccaatcctcctctccaacaacttcattgaacccctcgaaatcaccaaggagatctatgatctcaataatcccgaaaaggagcccaaaaagttccaaaccgcctacgcaaagaaaaccggcgaccagaagggctacagggaggccctctgcaaatggatcgattttaccagggactttctctccaagtacacaaagaccacaagcattgacttgtcatccctcaggcccagctcccagtacaaggacctcggcgagtactatgctgagctcaacccccttctctaccacatcagctttcagaggatcgctgagaaggaaattatggacgccgttgagaccgggaagctttacctcttccagatctataacaaggacttcgccaagggtcaccatggcaagcctaacctccatactctctactggacagggcttttcagccccgagaacctcgccaagacatccatcaagctcaacggtcaggccgaattgttctataggcccaagtctaggatgaagaggatggcccataggctcggggagaaaatgctcaacaaaaagctcaaggaccagaagacccccatccccgacaccttgtatcaggagctctacgactacgtgaatcacaggctcagccacgacctcagcgacgaggccagggccttgctccccaacgttatcaccaaggaggtgagccatgagatcataaaggacaggaggttcacctccgacaagttctttttccacgtcccaatcaccctcaattaccaagccgccaactcaccttcaaagttcaaccagagggtgaacgcctaccttaaggagcaccccgagacacctatcatcgggatcgacaggggggagaggaacctcatctacataaccgtgatcgactctactgggaagatccttgagcaaaggtccctcaacaccatccagcaattcgattatcaaaagaagctcgacaacagggagaaggagagggttgccgccaggcaggcttggagcgttgtgggcacaatcaaggacttgaagcagggctacctctcccaggtgatccacgagatagttgacctcatgatacattaccaggctgttgttgttctcgagaatctcaacttcggcttcaagagcaagaggacagggatcgccgaaaaagccgtctaccagcagttcgagaagatgctcatcgacaaacttaattgcctcgttctcaaagactatcccgcagagaaggtgggaggcgtgctcaacccctatcagctcaccgaccagtttacctccttcgccaagatggggacccaatcaggcttcctcttctacgtgcccgccccctacacctctaaaatcgatcccctcaccgggtttgtcgatcccttcgtctggaagaccatcaagaaccacgagtccaggaagcatttccttgagggcttcgacttcctccactacgacgtcaaaaccggggatttcatcctccactttaagatgaataggaacctctctttccagaggggcctcccagggttcatgcccgcctgggacatcgtgttcgagaagaacgagacccagttcgacgccaagggaacccccttcatcgccggcaagaggattgtccccgtcattgagaaccacaggttcaccggcagatatagagacctctaccccgccaatgaactcatcgccctcctcgaggaaaagggcatcgtcttcagggacgggtccaacatcctccccaagttgctcgagaacgacgattcccacgccatcgacaccatggtggctctcatcaggagcgtgctccagatgaggaacagcaacgccgccactggtgaggactacatcaatagccctgtcagagacctcaacggagtttgctttgacagcaggttccaaaaccccgagtggcccatggatgccgacgccaatggtgcctaccatatcgccctcaagggccaactcctccttaatcacttgaaggagagcaaggatctcaagctccagaatgggatcagcaatcaagactggctcgcatacatccaggagctcaggaat

SEQ ID NO: 53 - DNA, 3921 bp, Artificial
  synthetic
atgactcagttcgaggggttcaccaacctttaccaagtctcaaagacccttaggttcgagctcatccctcagggaaagactcttaagcacatccaggagcagggcttcatcgaagaggataaagccaggaacgaccattataaggagctcaaaccaatcatcgacaggatctacaagacctacgccgaccagtgcttgcaactcgttcagctcgactgggagaatctctccgccgcaatcgacagctacaggaaagaaaagaccgaggaaacaaggaacgccttgatcgaggaacaggccacctacagaaacgccatccatgactactttataggcagaaccgacaatctcaccgacgccatcaacaagaggcatgccgagatatacaaggggcttttcaaggcagagctctttaatgggaaggttttgaagcagctcggcaccgtcaccactaccgagcacgagaatgccttgttgaggtcattcgacaaattcaccacttacttctccgggttctatgagaataggaagaacgtctttagcgccgaagacatcagcacagccatcccacataggatcgtccaggacaatttccccaagttcaaagagaactgccacatcttcaccaggctcattaccgcagtgccaagtctcagggagcacttcgagaacgttaaaaaggctatcggcatcttcgtctccacatccatcgaggaagtgttcagctttcccttctacaaccagctcctcacccagacccagatagacctctacaaccagttgcttggaggaatcagtagggaggctggtaccgagaagataaagggactcaacgaggtcctcaacttggctattcagaagaacgacgagactgcacatatcatcgcctccctcccccataggtttatccccttgtttaagcagattctctcagacaggaacacactctcattcatcctcgaggagtttaagtctgacgaggaagttatccagagcttctgcaaatacaagactcttttgaggaacgagaacgttctcgagaccgccgaggcactcttcaatgagctcaactccatagatctcacccacatatttatctcccataagaagcttgagaccatttcctccgctttgtgtgaccactgggacacccttaggaacgctctctacgaaaggagaataagcgaactcaccggcaagatcaccaagagcgccaaggaaaaggtgcaaaggtctcttaagcatgaggatatcaacctccaggagatcattagtgccgccggcaaggagttgtccgaggcctttaaacaaaaaaccagcgagatcctctcacacgcacacgccgctctcgaccagccccttcctaccacccttaagaaacaggaggagaaggagatcctcaagtcacagttggactctctcctcggtctctatcatctcctcgactggttcgctgtggacgagagcaacgaggtcgaccctgagttctccgccagactcaccggcatcaagctcgaaatggagccctccctcagcttttataataaagccaggaactacgccaccaaaaagccctacagcgtggagaaattcaagctcaactttcaaatgcctaccctcgcctccggctgggatgtcaacaaggagaaaaacaacggggccatacttttcgtgaaaaatgggctctactatttggggatcatgcccaaacagaagggcaggtataaggccctctcctttgagcccactgagaagacaagtgaaggattcgataagatgtactacgactacttccccgatgccgccaaaatgatacccaaatgcagcacccagctcaaagcagtgaccgcccacttccagacacataccacccccatcctcttgagcaacaatttcattgaacccttggagatcaccaaagagatctacgatctcaacaaccccgagaaggagcccaagaagttccagaccgcctacgccaagaagacaggggatcaaaagggctacagggaggccctctgtaagtggatcgacttcacaagagatttcctcagcaagtataccaagaccactagcatcgatctctcctccctcaggccatcatcacagtacaaggatctcggggagtattacgccgagctcaatcctctcctctaccacataagcttccagaggatcgccgagaaggagataatggatgccgtggagaccgggaagctctacctctttcagatctacaacaaagacttcgctaaggggcaccacggcaagcccaacctccacaccctctactggaccggcctcttctcccccgagaacctcgccaaaacctccatcaagttgaacggccaggccgagttgttctacaggcccaagagcaggatgaagaggatggcccataggttgggagagaagatgctcaataagaagttgaaggaccagaaaacccccatccccgacacactctatcaggaactttatgactacgtcaaccacaggttgagccacgacctctccgacgaggccagagcactcctccccaacgtgatcaccaaggaggtctcccacgagatcatcaaggacaggaggtttaccagcgacaaatttttcttccacgtccctatcaccctcaactaccaggccgccaattcccccagtaaattcaatcaaagagtgaacgcctatctcaaggagcaccccgagacccccataatcggcatcgacaggggcgagaggaacctcatctacatcaccgttatcgattctaccggtaagatcctcgaacagaggagcctcaataccatccagcagttcgactatcagaaaaagctcgacaacagggagaaagagagggttgccgctagacaggcctggagcgtcgtcgggaccatcaaggatctcaagcagggttacctctcccaagtgattcacgagatcgtcgaccttatgattcactaccaggccgtggtcgttctcgaaaatcttaacttcgggttcaaaagcaagaggactgggatcgctgagaaagccgtgtaccagcagttcgaaaagatgctcatcgacaaactcaactgcctcgtcctcaaggactaccccgccgagaaggtcgggggggtgctcaacccctatcaactcaccgatcagttcaccagtttcgccaaaatggggacacagtccggattcctcttttacgtccccgccccctacacctctaagatagacccactcaccggcttcgtcgacccctttgtgtggaaaaccattaagaaccacgaaagcaggaagcatttcctcgaaggtttcgatttcctccactacgacgtcaaaactggagacttcatccttcacttcaagatgaacaggaacctttccttccagagggggcttcccgggtttatgcccgcatgggacatcgtcttcgagaaaaatgagacccaattcgacgcaaagggcacccctttcatcgccggcaagagaatcgtccccgtcatcgagaaccacaggttcaccggcaggtacagggacttgtaccccgccaacgagctcattgccctcctcgaagagaagggcatcgttttcagggacgggtccaacatcctccccaagctcctcgaaaacgacgactcacacgccatcgacaccatggttgctctcatcaggagcgtgctccagatgaggaattccaacgccgccaccggtgaggactatatcaactctcccgttagggacctcaacggagtgtgcttcgacagcaggttccagaatcccgagtggcccatggacgccgacgccaatggcgcctaccacatcgccctcaaagggcagttgctcctcaatcatctcaaggagtccaaggacctcaaactccagaacggcatcagcaaccaggattggcttgcctatatccaggagttgaggaac

SEQ ID NO: 54 - DNA, 3921 bp, Artificial
  synthetic
atgacccagtttgagggtttcaccaacctctaccaagtttccaagactctcaggttcgaactcatcccccagggaaaaacactcaagcacattcaggagcaggggttcatcgaggaggataaggcaagaaacgaccattacaaggagctcaagcctattattgacaggatctacaagacttacgctgaccaatgcctccagctcgtgcaactcgactgggaaaacctctccgccgcaatcgatagttacagaaaggagaagactgaggagactaggaacgccctcatcgaggaacaggccacctataggaacgccatccacgactacttcatcgggagaaccgacaacctcaccgacgccatcaacaagagacacgccgagatatacaagggcctcttcaaggccgaacttttcaacgggaaagttctcaaacagctcgggaccgttaccacaaccgagcacgagaacgccctcctcaggagcttcgacaagttcaccacatacttctccggattttacgaaaatagaaagaatgtcttcagcgccgaggacatttccaccgccatccctcacagaatcgttcaagacaactttcccaaattcaaagaaaactgccacatcttcaccagactcatcaccgccgttccctctctcagggagcactttgagaacgtcaagaaggccatcggtatcttcgtttctaccagtatcgaggaggttttctccttcccattctacaaccagctcttgacccagacccagatcgacctctataatcagctcctcggcggcatatctagagaggccggaaccgaaaagatcaaagggctcaacgaggtcctcaacctcgccatccagaaaaacgacgaaaccgctcatatcatcgcatccctcccccacagattcattcccttgtttaagcagatcttgtccgacagaaacactctctcctttatcttggaggaatttaagtccgacgaggaggttatccagtccttctgcaagtacaagaccctccttaggaacgagaacgtcctcgagaccgccgaggcccttttcaacgagctcaacagcatcgacctcactcacatcttcatcagccacaagaaacttgagaccatctcaagcgccctctgcgatcactgggacaccttgaggaatgccctctacgaaaggaggataagcgagctcaccggcaagatcaccaagtccgccaaggaaaaggttcagaggagcctcaagcacgaggacatcaacctccaggagattatcagtgccgcaggcaaagaacttagcgaggcatttaagcaaaagacctccgagattctcagccacgcccacgccgctcttgaccagcccctccccaccacccttaagaagcaggaggaaaaggagatcctcaaaagtcaactcgactccctcctcggcttgtatcacttgctcgattggtttgccgttgacgagtccaatgaagtcgatcccgagttcagcgccaggcttaccggcatcaagctcgaaatggagcctagtctctccttctacaacaaggccagaaattacgccaccaagaagccctactccgttgagaaattcaaactcaatttccagatgcccactctcgcttcagggtgggacgttaacaaagagaagaacaacggagccattcttttcgttaagaacggcctctactacttgggcatcatgcccaagcagaaggggaggtacaaggccctcagcttcgagcccaccgagaagacctccgaggggttcgataaaatgtactacgactattttccagatgccgccaagatgatccccaaatgcagtacccaactcaaagccgtgaccgctcatttccagacccacacaacccccatcctcctcagcaacaacttcatcgagcccctcgaaattaccaaggagatctacgacttgaacaaccccgagaaggaacccaagaagttccagaccgcctacgccaaaaaaaccggcgaccagaaagggtacagggaggccctctgtaagtggatcgactttaccagggattttttgtctaagtacaccaaaaccacatccatcgacctcagctccctcaggccctctagccaatacaaagacctcggtgaatactacgcagaactcaaccccctcctctaccacattagcttccagaggatcgctgagaaggagatcatggacgccgtggagaccgggaagctctacctcttccagatctacaataaggacttcgccaagggccaccacgggaagccaaatctccacaccctctattggaccgggctcttcagccccgaaaatcttgcaaagacaagcatcaagctcaacggccaagccgaactcttctacaggcccaagtccaggatgaagaggatggcccacaggctcggcgaaaagatgctcaacaagaagttgaaagaccaaaagacccccatccccgataccttgtaccaggagttgtacgattacgtcaaccataggctctcccacgatctctccgacgaggccagggcactcctccccaacgttattaccaaagaagtctcacacgagatcatcaaggacagaaggtttacatccgacaaattcttcttccacgttcccatcaccttgaattaccaagctgctaattcccccagcaagttcaaccaaagggtgaatgcctatttgaaggagcatcccgagacccccattataggcatcgacaggggggaaaggaaccttatctacattaccgttatcgactccaccggaaagatcctcgagcagaggtccttgaacactattcagcagttcgactaccagaagaagctcgacaatagggagaaagagagggtcgccgccagacaggcctggagcgtcgtcggtaccatcaaagacctcaagcagggctacctgagccaggtcatccacgagatcgttgacctcatgatccactaccaggccgtcgtcgttcttgagaacctcaactttggttttaagtccaagaggactgggatcgccgagaaggcagtgtatcagcagttcgaaaagatgctcatagacaagttgaactgtctcgttctcaaggactaccccgctgagaaggtgggaggcgtccttaacccctaccaactcaccgatcagttcacctccttcgccaagatgggaacccaaagcggcttcctcttttacgtcccagctccctacacctccaagatcgacccactcaccggtttcgtcgacccttttgtttggaagaccatcaagaaccacgagtccaggaagcacttcctcgaggggttcgacttcctccattacgatgtgaagaccggcgacttcatcctccatttcaagatgaatagaaacctctcattccaaagagggctccccgggttcatgcccgcttgggacattgttttcgagaagaacgagacccaattcgatgccaagggcacaccttttatcgccggcaagagaatagttcccgtcatcgagaaccacagattcacagggaggtacagagacctctaccccgctaatgagctcattgccctcctcgaggagaaagggatcgtcttcagggacggcagcaacatcctccccaaactcctcgaaaacgacgactcacacgccattgataccatggtcgcactcatcagatccgttctccagatgagaaattccaacgccgccaccggagaggactacataaacagccccgtcagggacctcaacggcgtgtgcttcgacagcaggttccaaaaccctgagtggcccatggacgctgacgctaacggagcctaccacatcgcccttaaggggcagctcctcctcaaccacctcaaagagagtaaagatctcaagttgcaaaacggaatcagcaaccaggactggctcgcctacatccaggagctcagaaat

SEQ ID NO: 55 - DNA, 3921 bp, Artificial
  synthetic
atgacccagtttgagggctttaccaacttgtatcaggttagcaaaacccttaggttcgaactcatccctcaaggtaagaccttgaaacacattcaggaacaggggttcatcgaagaagacaaagccaggaatgaccactacaaagagctcaaacccattatcgacagaatctataaaacttacgccgaccagtgtctccagctcgtgcagttggactgggagaatctcagcgccgccatcgacagctatagaaaagagaaaaccgaggagacaaggaacgccctcatcgaggagcaggccacttacaggaacgccatccatgactacttcatcggcaggaccgacaacctcaccgacgccatcaataagaggcatgccgagatctacaagggcctctttaaggccgagctcttcaacggcaaagtcctcaagcagctcgggaccgtgaccaccaccgagcacgagaacgcccttcttagatccttcgacaagttcaccacctatttcagtggcttctatgagaacagaaagaatgttttctccgccgaagacatcagcaccgccattccccacagaatagtgcaggacaatttccccaagttcaaggagaactgccacatcttcactaggttgatcaccgccgtcccctctctcagagaacattttgagaatgttaagaaggccatcggcattttcgttagtaccagcatcgaagaggtcttcagtttccccttctacaatcagttgctcactcaaacccagatcgacctttacaaccagctcctcgggggtatctccagggaggccggcaccgagaaaatcaaggggctcaacgaggtgcttaacctcgccatccaaaaaaacgacgaaaccgcccacatcatcgccagcctcccccataggttcatccccttgttcaagcagatcctttccgacagaaacactctctcctttatcctcgaggagtttaaaagcgacgaggaggtgatccagtccttctgcaagtacaaaacacttctcagaaacgagaacgtgctcgagaccgcagaggccctttttaacgagctcaacagcatcgacctcacccacattttcatctcccataaaaagctcgagaccattagctccgccctctgcgaccactgggacacactcagaaacgccctgtacgaaaggaggatcagtgagttgactgggaagatcaccaagagcgccaaggaaaaagtgcagaggtccctcaagcacgaggacatcaacctccaggaaatcatcagcgccgccggtaaggagctcagtgaggctttcaaacagaagacctccgagatactctcacacgcccacgctgcactcgaccagccattgcccaccaccctcaagaagcaagaagagaaggagatcttgaagtcccagctcgattccctcctcgggctctaccacctcctcgactggttcgccgttgacgagagcaatgaagttgaccccgagttctccgctaggctcaccggcatcaagctcgagatggagccctccctctccttctacaacaaggccagaaactacgccacaaagaagccctactccgtggagaagtttaaactcaacttccagatgcccaccctcgcctccggctgggatgttaacaaggaaaaaaacaacggcgccatcctctttgtgaagaacggactctactacctcgggatcatgcccaaacagaaaggcaggtacaaggcactctcatttgaacccaccgaaaagacaagcgaggggtttgataagatgtattacgattacttccccgacgccgcaaagatgatccccaagtgctctactcagttgaaagccgtcaccgcccattttcaaacccacaccacccccatcctcctttccaacaacttcatcgagcctttggagatcaccaaggagatctacgacttgaataaccccgaaaaggagcccaaaaagtttcagactgcatacgccaaaaagaccggcgaccagaagggatatagggaagccctctgcaagtggatagacttcactagagacttcctcagtaagtacaccaagaccacttcaatcgacctctcctctctcaggcctagctcccagtacaaagacctcggtgagtattatgcagagctcaatcctctcctttaccatataagcttccagaggatcgccgagaaggagatcatggacgccgtcgagacagggaagctctacctcttccagatctataacaaagattttgctaaagggcaccacggcaaacctaacctccacacactctattggacagggcttttcagccctgagaacctcgccaagaccagtatcaaactcaacggccaggccgagctcttctacagacccaaaagcaggatgaaaaggatggcccacaggctcggagagaagatgttgaataagaagctcaaggaccagaagacacccatccccgacaccctctatcaggagctctacgactacgtcaatcacaggctctctcatgacttgtccgacgaggccagggcccttctccccaacgtcatcaccaaggaggtctcccatgagattatcaaggacaggaggttcacctcagacaagttcttcttccacgtccctattaccctcaactaccaggccgccaacagccccagcaagttcaatcagagggtcaacgcctacctcaaggaacatccagagacccccatcatcggcattgacagaggtgagaggaacctcatctatatcaccgtgatcgactccactggcaagatcctcgagcagaggtccctcaacaccatccagcaattcgactatcagaagaagctcgacaacagggaaaaagagagggtggccgccagacaggcctggagcgtcgtggggaccatcaaggacctcaagcagggatacctttcccaggtgatccacgagatcgtcgacctcatgatccactatcaggccgttgtcgtgcttgagaacctcaacttcggatttaagtccaagaggaccggcatcgccgagaaagctgtgtaccagcagttcgaaaaaatgctcatcgacaagctcaactgccttgtcctcaaggactaccccgccgagaaggtggggggcgttctcaacccttaccagttgactgaccaatttacctcattcgccaagatggggactcagtccgggttcttgttctacgtccccgccccctacacatccaagattgaccccttgactgggtttgttgaccccttcgtctggaagaccatcaagaaccacgaatcaaggaaacacttcctcgagggtttcgacttcctccactatgacgtcaagaccggggacttcatcctccatttcaagatgaatagaaatcttagctttcagaggggtctcccaggtttcatgcctgcctgggatatagtcttcgagaagaatgagacccagttcgatgccaaaggcacccccttcatcgccgggaagaggatcgtgcccgtcatcgagaaccacaggttcactgggaggtacagggacctttaccctgccaatgaactcatcgccctcctcgaagagaagggaatcgtgtttagggatgggtccaacatccttcccaaactcctcgaaaacgacgacagccacgccatcgataccatggtcgccctcatcagaagcgttctccaaatgaggaactccaacgccgccaccggggaagactacatcaactcccccgttagggatcttaatggcgtgtgtttcgactccaggttccaaaatcccgagtggcccatggacgccgatgccaacggggcctaccacatcgccctcaaggggcagctccttctcaaccatttgaaagagagcaaagacctcaaattgcagaacgggatttcaaatcaggactggcttgcctatatccaagagctcaggaat

SEQ ID NO: 56 - DNA, 3921 bp, Artificial
  synthetic
atgacccagtttgaagggttcaccaacctctaccaggtgagcaagaccctcagattcgagttgatcccacaggggaaaactctcaagcacatccaagagcagggcttcatcgaggaagacaaagccaggaacgaccattacaaggagctcaagcccatcatcgacaggatctacaagacctacgcagaccagtgcctccagctcgtccagttggactgggagaacctcagcgcagccatagactcctatagaaaagagaagaccgaggagactaggaacgccttgatcgaggagcaggccacctacaggaatgccatacacgattacttcataggcagaaccgacaatctcaccgacgccatcaataagaggcacgccgaaatatataaggggctcttcaaagccgaacttttcaatggtaaagttctcaagcagttgggcacagtgaccaccaccgagcacgagaacgccctcctcaggtccttcgataaattcaccacctatttctccggtttctacgagaacaggaagaacgtctttagcgccgaagatatttcaactgccattccacacaggatcgtgcaggacaacttccccaaatttaaggagaactgccacatattcacaaggttgatcaccgctgtccccagtctcagagagcacttcgaaaatgtgaagaaggccatcggcatcttcgtttccacttccattgaagaagtgttctccttccccttctataatcagctcttgacccagacacagatcgacctctacaaccagctcctcggcgggatctccagagaagccggcaccgagaagatcaaagggctcaatgaggtgctcaacttggccatccagaaaaacgacgagaccgcccacataatcgcctccctcccccacaggttcatccccctcttcaagcagatactctccgacaggaacaccctctctttcatactcgaagagttcaagagcgacgaggaggtgatccagtcattctgtaagtacaagaccctcctcaggaacgagaacgtgctcgagaccgccgaggccctcttcaacgagcttaacagcatcgacctcacccacatcttcatctcacacaagaagcttgagaccatcagcagtgccctctgcgatcactgggacacattgaggaatgccctctatgagagaaggatctccgagctcaccggcaaaattaccaagagcgccaaggagaaggtgcagaggtccctcaaacacgaggacatcaacctccaggaaatcatcagcgccgctggtaaagaactctccgaggcatttaaacaaaagacctccgagatcctctcccatgcccacgccgccctcgatcagcccctccctaccacacttaagaaacaggaagaaaaggagatcctcaaaagccaactcgattctctcctcggtctctaccacctcctcgactggttcgccgtggacgagagcaacgaggttgaccccgaattcagcgctaggctcaccgggatcaagctcgagatggagccttccctctcattttataacaaggccaggaattacgccaccaagaagccttattcagtggaaaaattcaagttgaatttccagatgccaaccctcgcctccgggtgggacgtgaataaagagaaaaacaacggagccatcctcttcgtcaagaacggcctctattacttggggatcatgcccaaacagaagggcaggtacaaggccctcagctttgagcccactgaaaaaacaagtgagggcttcgacaagatgtactacgactacttccccgatgccgccaagatgatccccaaatgcagcacccaacttaaagccgttaccgcccactttcagacccacaccacccccatcctcctcagcaacaacttcatagagccccttgagatcaccaaggaaatctacgatctcaacaacccagagaaggagcccaaaaagttccagaccgcctatgccaagaagaccggggaccagaaaggctacagagaggcactctgcaaatggatcgactttaccagggactttttgagtaaatacaccaagaccacctccatcgacctcagctccctcaggcccagtagtcaatataaggatctcggcgagtactatgccgagctcaaccccctcctctatcacatcagctttcaaaggatcgccgagaaggagattatggatgctgtggaaaccggtaagttgtacctcttccagatctacaacaaagacttcgcaaagggacatcacgggaagcccaacctccacaccctctattggaccggccttttcagccccgagaatctcgccaagacctctataaaactcaacgggcaggccgaactcttctacagacccaagtctaggatgaagaggatggcccataggctcggcgagaagatgctcaacaagaagctcaaggatcagaaaactcccatccccgataccctctaccaggaactctacgactacgtgaaccacagactcagccacgacctctccgatgaggcaagggcactcctccctaacgtcatcaccaaggaggtgagtcatgaaatcatcaaggacagaaggtttacatccgacaagttcttcttccatgtccccatcaccctcaattaccaggccgccaacagcccctccaagttcaaccagagggtcaacgcctacctcaaagagcaccccgagacccccataatagggatcgacagaggcgaaaggaatctcatctacattaccgtcatcgacagcacaggcaagatcctcgagcaaaggtccctcaacacaatccagcagttcgattaccagaaaaagctcgataacagggaaaaggaaagggtggctgccaggcaggcctggtccgttgtgggaaccatcaaggaccttaaacagggctatctctcacaggtcatccacgagatcgtcgatcttatgattcactatcaggccgtcgttgtgctcgagaacctcaatttcggtttcaagtccaagaggaccggcatcgccgagaaggcagtctaccaacagttcgagaagatgctcatcgacaaactcaactgcctcgttctcaaggactaccccgccgagaaggttggaggggtgttgaacccctaccaactcaccgaccagttcacctcatttgccaaaatgggcacccaaagcggtttcctcttctatgtccccgctccctacactagcaagatcgaccccttgacaggcttcgtcgacccattcgtctggaagaccatcaagaaccacgaatccaggaaacactttcttgaggggtttgattttctccactacgacgtgaaaactggcgattttattctccatttcaagatgaacagaaacctctccttccagaggggcctccccgggttcatgccagcctgggacattgttttcgaaaagaacgaaacccaattcgacgccaaagggacacccttcatcgccgggaaaaggatcgtccccgtcatcgaaaaccataggttcaccggcagatacagggatctctatcccgccaacgagctcatcgcactcttggaggagaaggggatcgtgttcagggacggatccaacatcctcccaaagctcctcgagaacgacgactctcacgccatcgataccatggttgccctcatcaggagcgttctccaaatgagaaactctaacgcagccaccggagaggactatatcaacagccccgtgagggacttgaatggcgtttgcttcgacagcaggtttcagaaccccgagtggcccatggatgccgatgccaacggcgcatatcacatagccctcaagggtcagctcctcttgaaccacttgaaagaatctaaggacctcaagctccagaatggtatctccaaccaggactggctcgcctacatccaggaactcagaaac

SEQ ID NO: 57 - DNA, 3921 bp, Artificial
  synthetic
atgactcagttcgagggattcaccaacctctaccaagtctccaagaccctcaggttcgagctcatcccccaggggaagacacttaagcacatccaggagcaaggattcatcgaggaggacaaggccaggaacgaccactataaggagctcaagcccatcatcgataggatctacaagacttacgcagaccagtgcctccagctcgtgcagctcgactgggaaaacctcagcgcagccatcgacagctacagaaaggagaagaccgaggagaccagaaacgccctcatcgaggagcaagccacctacaggaacgcaatacatgactacttcatcggaaggaccgacaatctcacagacgccatcaacaagaggcacgccgagatctacaaggggctcttcaaggccgagctcttcaacggcaaggtgttgaagcagctcggcactgtgaccaccaccgaacacgagaatgccctcctcaggagtttcgataagtttaccacatactttagtggtttctacgaaaacagaaagaacgtcttctctgctgaagacataagcaccgccatcccccacagaatcgtgcaggataacttccccaagttcaaggagaactgtcatatcttcaccaggctcatcactgccgtgccttcccttagggagcatttcgaaaatgtcaagaaggccataggtatcttcgtgagcaccagcattgaagaggtgttttccttccccttctacaaccagctcctcacccagacccagatcgatctctataaccagctcttggggggcatttccagagaagccggtacagagaagatcaagggcctcaatgaggttctcaacctcgctatccagaaaaatgacgagaccgcacatataatcgcctccctcccccacaggttcatacccctcttcaaacagatcctctcagacaggaataccctcagcttcatcctcgaggagttcaagtccgacgaggaggtgatccagtccttctgcaaatacaagaccctcctcaggaatgagaacgtccttgagaccgccgaggccctctttaatgagctcaacagcatcgacttgacccacatcttcatctctcacaaaaagctcgaaacaatcagctccgccctctgcgaccattgggacaccttgaggaacgccctctacgaaaggagaatctccgagctcaccggcaagataacaaagagcgccaaggaaaaagtgcagaggagcctcaagcatgaggatatcaacctccaggagatcatctccgccgccggtaaggagctcagcgaggccttcaagcagaagacttccgagatcttgagccatgcccacgccgctttggaccagcccctccctacaaccctcaagaagcaagaggagaaggagattctcaagagccagctcgactcattgctcggactctaccacctcctcgactggtttgccgtggacgagtccaacgaggtcgaccccgaattctccgccaggttgaccggcataaaactcgagatggagccctcactcagcttttacaataaggccaggaactacgcaacaaagaagccctactccgtcgaaaagttcaagctcaacttccagatgcccaccctcgcatccgggtgggatgtgaacaaggagaagaacaacggggccatcctctttgtcaagaatgggctctactacctcgggatcatgcccaagcagaaaggtagatataaagccctcagcttcgagcccacagagaagacctccgaaggattcgacaagatgtattacgactacttccccgatgccgccaaaatgatccccaagtgcagcacccaactcaaggcagtgaccgcccatttccagacccacactacccccatcctcttgagcaacaattttatcgagcccttggagatcaccaaggagatctatgacctcaacaatccagagaaggagcccaagaagttccaaaccgcctatgccaagaagaccggcgaccaaaagggctacagggaggccctctgcaagtggatcgattttaccagggacttcctcagcaagtacaccaaaactacctctatcgaccttagcagcctcagaccctcaagccagtataaggacctcggcgagtactacgccgagctcaatcccttgttgtaccatatcagctttcagaggatcgccgagaaggagatcatggacgccgtcgagaccgggaagctttacttgttccaaatctacaacaaggacttcgccaagggacaccacggcaagcctaacctccacaccctctactggaccgggctcttttcccccgagaacttggccaagacctctatcaagctcaacggccaggccgagctcttctatagacccaagagcaggatgaagaggatggcacacagactcggggagaagatgctcaacaagaagctcaaggatcagaagacccccatccccgacaccctctaccaagaactctacgattacgtcaaccacagactctctcacgatctctctgacgaagcaagagctctcctccccaacgtgattactaaggaggtctcacacgagattataaaggacaggagattcacctccgacaagttcttcttccacgtccccatcaccctcaactaccaggctgccaacagcccatccaagttcaaccagagggttaacgcctacctcaaggaacatcctgagacccccatcatcggcatcgacaggggggagaggaacttgatttacatcaccgtcatcgacagtaccggtaaaatcctcgagcagaggagcctcaacaccatccagcagttcgactatcaaaagaagctcgacaacagagagaaagagagagtggctgctaggcaagcctggagcgttgtgggaacaattaaagacctcaagcagggctacctttcccaagtgatccacgaaatcgtggacctcatgatccactatcaggccgtcgtcgtccttgaaaacctcaattttggtttcaaaagtaagaggactggtatcgccgagaaggccgtctaccaacagttcgaaaaaatgctcatcgacaaactcaactgcttggtgctcaaagactaccccgccgaaaaggtgggaggcgtcctcaacccataccagctcaccgaccaattcactagctttgctaagatgggaacccagtccgggtttttgttctacgttcccgccccctacacaagcaagatagaccccctcactgggtttgtggaccccttcgtgtggaagaccataaaaaaccacgagagcagaaaacattttctcgagggattcgactttctccactacgatgtcaaaaccggtgactttatactccacttcaagatgaacagaaatctctcctttcagagaggcctccctgggttcatgcccgcctgggacatcgtcttcgagaagaacgagacccagtttgacgctaagggcacccccttcatcgccggcaagaggatcgtgcccgtcatcgaaaaccacaggttcaccggcaggtatagggatctctaccccgccaacgagctcatcgccctccttgaagaaaagggtatcgtcttcagagacgggagcaatatcctcccaaagttgttggagaacgacgatagccacgccatcgacaccatggtcgcccttatcaggtccgtcctccagatgaggaactctaacgccgccaccggagaggactacataaactcacccgttagagacctcaacggcgtttgtttcgactccaggtttcaaaatcccgagtggcccatggatgccgacgccaacggggcttaccacatcgccttgaaggggcagcttcttctcaaccacctcaaggagagcaaggacctcaagctccaaaacgggatcagcaaccaagactggttggcctatatccaggagctcagaaat

SEQ ID NO: 58 - DNA, 3921 bp, Artificial
  synthetic
atgacccagttcgagggcttcaccaacctctatcaggtctctaagacactcagatttgaactcatcccccaggggaaaaccctcaaacacatccaggagcagggctttatagaggaggacaaggcaaggaatgaccactataaggagcttaagcccatcattgataggatctacaaaacctacgccgatcagtgccttcagctcgttcagctcgactgggagaacctcagcgcagccatcgattcctacaggaaggaaaaaaccgaggagaccaggaacgcactcatcgaagagcaggccacctacagaaacgccatccatgattatttcatcggcaggaccgacaacctcaccgacgccatcaataagaggcatgctgagatctacaagggccttttcaaggctgagctcttcaacgggaaggtgcttaagcagcttggcaccgtcaccaccaccgagcacgaaaatgcattgcttaggtcattcgacaagttcacaacctattttagtggtttctatgaaaataggaagaacgtgttctccgccgaggacatcagtaccgccatcccccacagaattgtgcaagacaacttccccaaattcaaggagaactgccacatctttaccagactcatcaccgccgtgcccagcttgagggagcacttcgagaacgtcaagaaagccatcgggatctttgtcagcacctccatcgaggaggtgttctccttccccttctataaccagctcctcactcagacccagatcgacctctacaatcagctcctcggcggaatctccagggaggcaggtaccgagaagataaaagggcttaatgaggtcctcaacctcgccatccagaaaaatgacgaaaccgcccacatcatcgcctccctcccccacagatttatccccttgttcaagcaaatcctcagcgacaggaacaccctcagcttcattcttgaggagttcaagagcgatgaagaagttatccagtccttctgcaagtacaaaacactgctcaggaacgaaaatgtgctcgaaaccgccgaagccctcttcaacgagctcaacagcattgacctcacccacatcttcatcagccacaaaaagcttgagaccatcagctccgctctgtgcgaccattgggacactctcaggaacgccctttacgaaaggaggataagcgagcttaccggcaagatcaccaaatccgccaaagagaaggttcagagatccctcaagcacgaggacatcaacctccaagagattatcagtgccgccgggaaggagctttctgaagccttcaagcagaagaccagcgagatcctttcccacgcccatgctgccctcgaccagcctctccccaccaccctcaagaagcaggaggagaaggaaattctcaagagccagctcgacagtctcctcggcctctaccaccttctcgactggttcgccgtcgacgagtccaatgaagtcgaccccgaatttagcgccaggctcaccgggattaagctcgagatggaaccaagtcttagcttctataacaaggccaggaattacgccaccaagaagccttactcagtggagaagttcaagcttaacttccagatgcccacacttgcctccgggtgggacgtgaacaaggaaaagaacaacggagcaatactcttcgtcaagaacgggttgtactatctcggcattatgcccaagcagaaaggcaggtacaaggctctctcctttgagcctaccgagaaaacctcagagggtttcgacaaaatgtactacgactacttccctgacgccgccaagatgatccccaagtgctccacccagctcaaggccgtcaccgctcatttccaaactcacaccactcccatcctccttagcaacaactttatcgagcccctcgagatcaccaaagagatctacgacctcaacaacccagagaaggaacccaagaagttccaaaccgcctacgccaagaaaaccggggaccagaagggctatagggaggctctctgcaagtggatagacttcaccagagactttctctccaagtacacaaagaccacctccatcgacctctccagcctcaggccctcctcccagtacaaggaccttggggagtactacgcagagctcaacccactcctctaccatatttcatttcagaggattgccgagaaggagatcatggacgccgtcgagaccgggaaactctacctcttccagatatataacaaggacttcgccaaggggcaccacgggaagcccaacctccacaccctctactggaccgggctctttagcccagagaatctcgccaaaaccagcatcaagctcaatggccaggccgagcttttctataggccaaagagcaggatgaagaggatggcccacaggcttggcgaaaagatgcttaacaagaagctcaaggatcagaaaacccccatccctgacaccttgtaccaagagctctacgactacgtgaaccatagactctcccacgatctcagtgacgaggccagggccctcctccctaacgttattactaaggaagtctcacatgagatcatcaaagacagaaggttcaccagcgataagtttttctttcacgtccccataacactcaactaccaggctgccaactccccaagcaagttcaatcagagggtcaacgcctacctcaaggagcaccctgagacccccatcataggaatcgacaggggggagaggaacctcatatacatcaccgtgatcgacagcaccgggaaaattctcgaacaaagatccctcaacacaatacagcagtttgactatcagaagaagttggataacagggagaaggagagggtggccgccaggcaggcctggagcgtggtcgggaccatcaaggacttgaagcaggggtacctctcccaggtcatccatgagatcgttgacctcatgatccactaccaggcagtggtcgtgctcgaaaatctcaatttcggtttcaaaagcaagaggaccgggatcgccgagaaggctgtttaccagcaattcgaaaagatgctcatagacaagcttaactgcttggtgctcaaagactaccccgctgagaaggtgggaggcgtgctcaacccataccaattgaccgatcaatttaccagcttcgccaaaatggggacccaatctggcttcctcttctacgtccctgccccatacaccagcaagatcgatccactcactggtttcgttgatcccttcgtttggaagaccatcaagaaccatgagtccaggaagcacttcctcgagggttttgacttcctccactacgacgtgaagaccggtgatttcatccttcacttcaagatgaataggaacctcagctttcagagggggctccccgggtttatgcccgcctgggacatcgtcttcgagaagaacgagacccagtttgacgccaaggggacacccttcatcgctggcaagaggatcgtcccagttatcgagaaccataggtttaccgggaggtacagagacctctaccccgctaacgaactcatcgctttgctcgaagagaaaggtatcgtgttcagggatgggagtaatatactccccaagctcctcgagaacgacgactcccacgcaatcgataccatggtcgccctcatcaggtccgtccttcagatgagaaatagcaacgcagccactggagaagactacatcaactcccccgtgagagacttgaacggcgtctgcttcgattccagattccagaaccccgagtggcccatggacgccgacgctaacggggcctaccacatcgccctcaagggccagcttctcctcaaccacctcaaggaatccaaggaccttaagctccagaacggcattagcaaccaggactggttggcatacatccaagagctcaggaac

SEQ ID NO: 59 - DNA, 3921 bp, Artificial
  synthetic
atgacccagttcgaagggttcaccaacctctatcaggtcagcaagaccctcagattcgagctcatcccccagggtaaaaccctcaagcacatccaggaacaagggtttatcgaggaagacaaggccaggaatgatcattacaaggagctcaagcccattatcgatagaatctacaagacctacgctgatcaatgtctccagttggtgcagctcgactgggaaaacctctctgccgccatcgattcctacagaaaggaaaagaccgaggagaccaggaatgccctcatcgaagagcaagcaacctacagaaacgcaatccacgattacttcatcggcaggaccgacaacctcactgatgctataaacaagaggcacgccgaaatatacaaggggcttttcaaagcagagctcttcaacggcaaggtgctcaaacaactcggcaccgtcaccaccaccgaacatgaaaacgccctcctcagaagcttcgacaaattcaccacctacttcagcggtttttacgagaataggaaaaacgttttctccgccgaggacatcagcaccgctatccctcacagaatcgtgcaagacaacttccccaagttcaaggagaactgtcacatcttcaccaggctcattaccgccgtccccagtctcagggagcacttcgaaaacgtcaagaaagccatagggatcttcgttagcacctccatcgaagaggtcttcagtttccccttttacaaccagctcctcacccagacccagatcgacttgtacaatcaactcctcggagggatcagcagagaggctgggaccgagaagattaagggactcaatgaggtcctcaacctcgccatccagaagaacgacgagaccgcccacatcatcgcctccctcccccacaggttcatccccctcttcaagcagatactctccgacaggaataccctcagtttcatccttgaggagttcaagagcgatgaggaagttatacagagcttctgcaaatacaagaccctccttaggaatgagaacgttttggagaccgctgaggcactctttaatgagctcaactccatcgaccttacccacatcttcatctctcataagaagctcgagactatatcttccgctctctgcgatcactgggacaccctcagaaacgccctctatgagaggaggatctccgaattgaccggcaagatcaccaagtccgccaaggagaaggtccaaaggagcctcaagcatgaggacatcaatctccaggaaatcatatcagccgccggaaaagagttgtccgaagcattcaagcagaagacctccgaaatactcagccacgctcacgctgccctcgatcaaccactccccaccaccctcaagaagcaggaagagaaggaaatcctcaagtcccagttggatagcctgttgggcttgtaccacctcctcgactggttcgcagttgacgagtccaacgaggttgaccccgaattcagcgccaggctcaccgggatcaagctcgaaatggagccctctctctccttctacaacaaggccaggaactatgccaccaagaaaccctacagcgtggaaaagttcaagctcaacttccaaatgcccacactcgcctcaggttgggatgtgaacaaggaaaaaaacaacggcgcaatcctcttcgtcaagaacgggctctactatcttgggatcatgcccaaacagaaagggaggtataaggccctctccttcgagcctaccgagaaaacctccgagggttttgacaagatgtactacgactactttcctgacgccgccaagatgatccccaagtgcagcacccagctcaaggccgtcaccgcccacttccagacacacaccacccccatcctcctctccaacaacttcatcgaacccttggagatcaccaaggagatatacgatctcaacaacccagaaaaggagcctaagaagttccagaccgcctacgccaagaaaacaggggatcagaaagggtacagggaagccctctgtaagtggatcgactttaccagggacttcctctccaagtacacaaagacaacctccattgatctttccagcctcagacccagctcccagtacaaagacctcggggagtactacgctgagttgaaccccctcttgtaccatattagcttccaaaggatcgccgagaaggagatcatggacgccgtcgagaccggtaagctctacctcttccagatttataacaaggatttcgccaaagggcaccacgggaagcccaaccttcataccctctactggaccgggctcttttcccccgaaaacctcgccaagacctccataaagctcaacgggcaggccgaacttttctacaggcctaaatcaaggatgaaaagaatggcccacagattgggcgagaagatgctcaacaagaagctcaaggaccaaaagactcccataccagataccttgtaccaagaactctatgattacgtcaaccacaggctctctcatgacctcagcgacgaggctcgagcccttctccccaacgtgatcaccaaggaggtttcacacgagatcatcaaggacaggagattcacctccgataagtttttcttccatgtgcccatcactctcaattaccaggccgccaactcccccagcaagttcaaccagagggtgaacgcctacctcaaagagcaccccgagacccccatcatcgggatcgatagaggggaaaggaatctcatctacattaccgttatcgacagtaccggcaagatactcgagcagagaagtcttaacacaatccaacagttcgattaccagaagaagctcgacaacagagagaaggaaagagtcgccgccagacaggcctggtccgtggtcgggactatcaaggacttgaagcagggctacctcagtcaggttattcacgaaatcgtcgatctcatgatccactaccaggccgtcgttgtgctcgagaatctcaacttcgggttcaaaagcaagaggaccgggatcgccgagaaggccgtgtaccagcagttcgagaagatgttgatcgataaactcaattgtttggtgctcaaggactatcccgctgagaaagtgggtggagttctcaacccctaccagctcaccgaccagttcaccagtttcgccaaaatggggactcagagcgggttcctcttctacgtccccgccccctatacctccaagatcgaccccctcaccggcttcgttgacccttttgtttggaaaactatcaaaaaccatgagagcaggaagcacttcctcgaggggtttgatttcctccactacgatgttaagaccggcgatttcatcctccacttcaagatgaacaggaatctctccttccagaggggccttcccggcttcatgcctgcctgggacatagtcttcgagaagaacgaaacccaattcgacgccaagggcacaccattcatcgccggcaagaggatcgtgcctgtgatcgaaaaccacaggttcaccggcagatacagagatctctatcctgccaacgagctcatcgcactcctcgaggagaagggcattgtcttcagggacggaagtaatatccttccaaagcttctcgagaacgacgactcccacgccatcgacaccatggttgctctcatcaggtccgtgctccagatgaggaattccaacgccgccaccggcgaggattacataaacagccccgtcagggacctcaacggggtttgcttcgactccaggttccaaaaccccgagtggcccatggacgctgacgctaacggcgcataccacatcgcactcaaaggccagctcctcttgaaccatctcaaggagtcaaaagacctcaagctccagaacgggatcagcaaccaggattggttggcctacatacaggagctcaggaac

SEQ ID NO: 60 - DNA, 3921 bp, Artificial
  synthetic
atgacacaattcgagggcttcacaaacctctaccaggtcagcaaaaccctcaggttcgagctcatccctcaggggaagaccctcaaacacatccaggagcaggggttcatagaggaggacaaggctaggaatgaccattacaaggagcttaagccaatcatcgacaggatctataaaacctatgccgaccaatgcctccagctcgtgcagcttgactgggaaaacctctccgccgccatcgacagctataggaaggagaaaaccgaggaaaccagaaacgcccttatcgaagaacaagcaacctacaggaacgccatccatgactacttcatagggaggacagacaatctcaccgacgccatcaacaagaggcacgccgagatctacaaaggccttttcaaggcagagttgtttaacgggaaggtcctcaagcagttgggtacagtcaccaccaccgaacacgaaaacgccttgttgaggtccttcgacaagttcaccacctacttcagcggcttctatgaaaacaggaaaaacgtcttctctgccgaggatatctcaaccgccatcccccataggattgtgcaagacaacttccccaagtttaaagagaactgtcacatcttcaccagactcatcactgctgtgcccagtctcagggaacacttcgagaatgtcaaaaaggccatcggcatcttcgtctctacaagcatcgaggaggttttcagcttccctttctacaaccagttgctcacccaaacccagattgatctctacaatcaactcctcgggggcatcagcagggaggccgggaccgagaagatcaagggccttaacgaggtcctcaacctcgccatccagaagaacgatgagaccgcccatatcattgccagcctccctcacaggttcatccccctttttaagcagatcctcagcgataggaataccctctcattcatcctcgaggaattcaagtccgacgaggaagtcattcagtccttctgtaagtataagaccctcctcaggaatgaaaatgttctcgagaccgccgaggctctcttcaacgaactcaactccatcgatcttacccacatattcataagccacaaaaagctcgagaccataagcagcgccctctgcgaccactgggatactctcagaaacgccctctacgagaggaggatctccgagcttaccggtaagatcaccaagtccgccaaggagaaggttcagaggagcctcaagcacgaggatatcaacctccaggaaataatctcagccgccgggaaggagttgagtgaggctttcaaacagaagacaagcgaaatcctcagccacgcccacgcagccctcgaccaaccactccccaccaccctcaaaaagcaagaggaaaaggagatactcaaaagccagcttgattcattgctcggcctctaccacctcctcgactggttcgccgtggacgaatccaacgaggtcgaccccgaatttagcgctaggctcaccggaatcaaactcgagatggagcccagcctcagcttctacaacaaggccaggaactacgccaccaagaagccttactccgtggagaagttcaaactcaacttccagatgccaaccctcgcctccggttgggacgtgaacaaagagaagaacaatggtgctatcttgttcgtgaagaatgggctttattaccttggaatcatgcccaaacagaaaggaaggtacaaggccctctcattcgaacccaccgaaaagacttccgaggggttcgacaagatgtattacgactacttccctgatgccgcaaagatgatacccaagtgctccactcaactcaaggccgtcaccgcccacttccagacccacaccacccccatcttgctctccaataacttcatagaacctctcgaaatcaccaaggagatctacgatcttaataacccagagaaggagcccaaaaagttccaaaccgcatacgccaagaagaccggggaccagaaggggtacagggaagccttgtgcaagtggatagactttaccagggacttcttgtccaagtataccaagaccaccagtatcgatctcagctctctcaggcccagcagccagtacaaggatttgggggagtactacgccgagttgaaccccctcctctaccacatctcattccagaggatcgccgagaaggaaatcatggatgcagtcgagactggcaagctctacctcttccagatctataacaaggacttcgccaagggccaccacgggaagccaaacctccatacactctattggaccgggttgttttcccccgagaaccttgccaagacctccatcaagttgaacgggcaggccgagctcttctacagacccaagagcaggatgaagagaatggcacacaggctcggtgagaagatgctcaacaagaagctcaaggaccagaaaactcccatccccgacaccctctaccaggagttgtatgactacgttaaccacaggctctcccatgacctctccgacgaagctagagccctccttcccaacgtcatcaccaaggaggtctcccacgagatcatcaaagacaggaggtttaccagcgacaagttcttctttcacgtccctataacccttaactaccaggctgctaactccccctccaaatttaaccagagggtcaacgcttaccttaaggaacaccccgagacacccattattggaatcgacagaggcgaaaggaacctcatctatattaccgtcatcgacagcaccggcaagatcctcgagcagaggagcctcaacaccatccagcagttcgactatcagaagaagttggacaatagagagaaagagagggtcgccgccaggcaagcctggagcgtcgtgggaaccatcaaggacctcaagcagggatatctctcccaggtcatccacgagatagtggatctcatgatccattaccaagccgtggtggttctcgagaacctcaacttcggcttcaagagcaagaggaccggcatcgccgaaaaggccgtttaccaacagtttgagaagatgttgatcgacaaattgaactgcctcgtccttaaagattaccctgccgagaaggtgggtggggttttaaacccctaccagctcaccgaccagttcacctcctttgccaagatgggcacccagagcggcttcctcttctacgttccagccccctacacctccaagatcgatcccctcaccgggttcgtggaccccttcgtctggaagaccatcaagaaccacgaaagcagaaagcatttcctcgaagggttcgactttctccactacgatgtgaagaccggggatttcatcctccacttcaagatgaataggaaccttagcttccagagggggttgcctggatttatgcccgcctgggacatcgtgtttgagaagaacgagactcagttcgacgccaaggggactcccttcatcgccggcaagaggatcgtgccagtaatcgagaatcatagattcaccggcaggtatagggacctttaccccgccaacgagctcatcgccctcctcgaggagaagggcatcgtttttagagacgggtccaacatccttcccaaactcctcgagaacgacgattctcacgcaatcgataccatggtcgccctcatcaggagcgtgctccagatgagaaactccaacgccgccactggcgaggactatattaactcccctgttagggaccttaacggcgtgtgtttcgatagcagattccagaatccagagtggcccatggacgccgatgctaatggggcctatcatatcgctcttaagggacagctcctcttgaaccaccttaaggagtccaaggacttgaaattgcagaatgggatatccaaccaggactggctcgcctacattcaggagctcaggaat

SEQ ID NO: 61 - protein, 1064 aa, Unknown
  Smithella sp.
MEKYKITKTIRFKLLPDKIQDISRQVAVLQNSTNAEKKNNLLRLVQRGQELPKLLNEYIRYSDNHKLKSNVTVHFRWLRLFTKDLFYNWKKDNTEKKIKISDVVYLSHVFEAFLKEWESTIERVNADCNKPEESKTRDAEIALSIRKLGIKHQLPFIKGFVDNSNDKNSEDTKSKLTALLSEFEAVLKICEQNYLPSQSSGIAIAKASFNYYTINKKQKDFEAEIVALKKQLHARYGNKKYDQLLRELNLIPLKELPLKELPLIEFYSEIKKRKSTKKSEFLEAVSNGLVFDDLKSKFPLFQTESNKYDEYLKLSNKITQKSTAKSLLSKDSPEAQKLQTEITKLKKNRGEYFKKAFGKYVQLCELYKEIAGKRGKLKGQIKGIENERIDSQRLQYWALVLEDNLKHSLILIPKEKTNELYRKVWGAKDDGASSSSSSTLYYFESMTYRALRKLCFGINGNTFLPEIQKELPQYNQKEFGEFCFHKSNDDKEIDEPKLISFYQSVLKTDFVKNTLALPQSVFNEVAIQSFETRQDFQIALEKCCYAKKQIISESLKKEILENYNTQIFKITSLDLQRSEQKNLKGHTRIWNRFWTKQNEEINYNLRLNPEIAIVWRKAKKTRIEKYGERSVLYEPEKRNRYLHEQYTLCTTVTDNALNNEITFAFEDTKKKGTEIVKYNEKINQTLKKEFNKNQLWFYGIDAGEIELATLALMNKDKEPQLFTVYELKKLDFFKHGYIYNKERELVIREKPYKAIQNLSYFLNEELYEKTFRDGKFNETYNELFKEKHVSAIDLTTAKVINGKIILNGDMITFLNLRILHAQRKIYEELIENPHAELKEKDYKLYFEIEGKDKDIYISRLDFEYIKPYQEISNYLFAYFASQQINEAREEEQINQTKRALAGNMIGVIYYLYQKYRGIISIEDLKQTKVESDRNKFEGNIERPLEWALYRKFQQEGYVPPISELIKLRELEKFPLKDVKQPKYENIQQFGIIKFVSPEETSTTCPKCLRRFKDYDKNKQEGFCKCQCGFDTRNDLKGFEGLNDPDKVAAFNIAKRGFEDLQKYK

SEQ ID NO: 62 - DNA, 3192 bp, Artificial
  synthetic
atggaaaagtataagatcacaaaaacaatccgattcaagctacttcctgacaaaatacaggatatttctcggcaggtggccgtgttgcaaaattcaacgaacgcagaaaaaaagaacaatttgttgaggctcgttcaaagggggcaagagctcccaaagctcttgaatgaatacattaggtattccgataatcacaaactcaaaagtaacgttacggtgcatttcaggtggcttagattattcactaaggacttattttataattggaaaaaagacaacaccgaaaagaagataaagatttccgatgttgtttatctgagccacgtttttgaagctttcctgaaggagtgggagtccacaattgagagggtgaacgcagattgcaacaaaccggaagaatccaaaacacgcgatgcagaaatcgcactctcaatcagaaaactcggcatcaaacatcaattgccttttattaagggattcgtggacaactctaacgataagaattcagaggatactaaatctaagctaaccgcacttctgtccgagtttgaagctgtgcttaaaatttgtgagcagaactacttaccctctcagtcatcgggtattgcaatcgctaaagccagtttcaactactatacaattaacaagaagcaaaaggattttgaggctgagatagttgctttaaagaagcagttgcacgccaggtatggaaataaaaagtatgaccagctactgagagagctaaacctcattccacttaaagaattgcctcttaaagaacttccgcttattgaattttacagcgaaatcaagaagagaaagtccaccaaaaagtccgagttccttgaagctgtctcaaatgggttggtctttgatgatcttaagagtaagttcccattgtttcaaacagagagcaacaaatacgacgagtaccttaaactatcaaacaaaatcacccaaaaatccactgcaaagagccttctctcaaaagacagcccagaggcacagaaattacaaactgagattacaaagctgaaaaaaaataggggagagtatttcaagaaggcattcggcaagtatgtgcaattgtgtgagctgtataaagagatcgcaggaaagcggggcaagcttaaggggcaaattaagggaatagaaaacgagcgcatagattcacagaggctccaatactgggctttggtcctggaggataacttgaagcatagtttaattttgattcctaaggaaaagactaacgagttgtatcgaaaggtttggggtgcaaaggatgacggtgccagttcctccagcagtagtaccctatattacttcgaatccatgacgtacagggcactacgtaaactctgttttgggattaacggaaatacatttctccctgaaatccagaaagaactacctcagtacaaccaaaaggagttcggcgaattctgctttcataagtccaatgacgacaaagagatcgatgagccaaagttgatctcgttctaccagtcagttctcaagacagatttcgttaagaacacactagctctccctcaatcagttttcaatgaggtagctatccaatcatttgagacgaggcaggattttcaaattgctcttgagaaatgttgttatgcaaagaagcaaattatttctgagagcctgaaaaaagagattcttgaaaattataacacgcagatttttaaaattacgtctcttgaccttcagaggagcgagcagaagaatctgaaggggcacacaaggatctggaatagattttggacaaaacagaacgaagagataaattacaatcttcgtttaaatcctgagattgctatcgtgtggagaaaggctaagaagactaggattgaaaagtacggagaaagatctgtgctttatgagccagagaagaggaatagatatttacacgaacaatatacactgtgtaccaccgtgactgataatgctttgaacaatgagataacttttgctttcgaggatactaagaaaaagggtaccgagattgttaagtataatgaaaagatcaatcagactttgaagaaagaatttaataagaatcaattgtggttttacggaattgacgccggtgaaattgagcttgctacactggcccttatgaacaaagacaaggaacctcaattgtttacggtgtacgaactgaagaagcttgacttcttcaaacacggttacatttataacaaagagcgtgagttggttattcgcgaaaagccttacaaggctatccaaaatctttcttatttcctgaacgaggaactttacgagaagactttcagggacggaaagtttaacgaaacctataacgagttatttaaggagaagcatgtgagtgccatagacttgaccacagccaaggtaattaacggtaaaattatattgaacggagatatgattacgttcttgaatttgaggattcttcacgcgcagagaaagatttatgaagagcttattgaaaatcctcatgccgaacttaaggagaaggactataagctttattttgagattgaaggtaaggataaagatatatatatctccaggttggatttcgaatacattaagccgtaccaggagatcagtaattatttgtttgcctactttgcatctcaacagattaacgaggccagagaagaagagcagattaatcaaactaagagagctctagccggaaacatgataggagtgatttattatttataccagaagtacagaggaattattagcatcgaggacctcaagcaaacgaaggtagagtcagatagaaataagtttgagggcaacattgagagaccacttgagtgggcactttacaggaaatttcagcaagaaggatatgttcctccaattagtgagcttataaagctaagagagcttgagaagtttccactgaaggatgtgaaacaaccaaaatacgaaaatatccagcaattcggtattatcaaatttgtttctccagaagagacatcaaccacctgcccgaaatgtttgcgccgatttaaggactacgataaaaataaacaggaaggattctgcaagtgtcaatgcggttttgatacgagaaacgatttgaagggattcgagggactgaatgacccagacaaagtggctgcctttaatattgctaaaaggggatttgaggacttgcaaaagtacaaa

SEQ ID NO: 63 - DNA, 3192 bp, Artificial
  synthetic
atggagaagtacaagattaccaagacaattaggttcaaactcctccccgataagattcaggatatctccagacaagtcgccgtcctccaaaacagcacaaatgccgagaagaagaacaacctccttagactcgtgcagagggggcaggagctccccaaacttctcaatgagtatatcaggtattctgacaatcataagctcaagagcaacgtgaccgtccacttcaggtggctcaggcttttcaccaaggacctcttctacaactggaagaaggataacaccgagaagaagattaagatctccgacgttgtgtacctctcccacgtcttcgaggcctttctcaaagagtgggagagtaccatagagagggttaacgccgactgcaacaagcctgaagagtccaaaactagggacgccgaaatcgccctcagcatcaggaagcttggcataaagcatcagctccccttcatcaaaggcttcgtggacaactccaacgacaaaaactccgaggacaccaaatccaagctcacagccttgcttagcgagttcgaggccgtgctcaagatctgtgagcagaactacctcccctcccagagctccgggatcgccatcgccaaagcctccttcaactactacaccattaacaagaagcaaaaggacttcgaagccgagatcgttgccctcaagaaacaactccacgctaggtacggcaataaaaagtacgaccaacttctcagggaactcaacctcatcccactgaaggagctcccccttaaggagcttccactcatcgagttctattccgagatcaagaagaggaaatctaccaagaaatccgagtttctcgaggctgtctccaacggcctcgtcttcgacgaccttaaatccaaatttcccttgttccagaccgagagcaacaaatacgatgagtacttgaaattgtccaacaagataacccagaagagcaccgccaagtcccttctctccaaggacagccctgaggcccagaagctccaaaccgagatcacaaaactcaaaaagaataggggggagtacttcaagaaagcctttggcaagtacgtgcagctctgcgaactctacaaggagatcgccggcaagaggggcaaactcaaaggccagataaaggggatcgagaatgagcggatcgatagccagaggcttcagtactgggctctcgtcctcgaggacaatctcaagcatagcttgatcctcattcccaaggagaagaccaatgaattgtataggaaggtctggggtgcaaaggatgatggcgcatccagctctagtagctccaccctctactatttcgagtcaatgacctatagggcccttaggaagctctgcttcgggatcaatggcaatacctttcttcccgaaatccagaaggagctcccacagtacaaccaaaaggagtttggtgagttctgcttccacaagagcaacgacgataaggagatcgacgagcctaagctcatttccttctaccaatcagtcctcaagactgacttcgttaagaacacccttgccttgccccagtccgtcttcaacgaagtggccatccagagcttcgagaccagacaggatttccagatcgccttggagaagtgctgctatgccaagaaacagatcatctccgagtccctcaagaaggagatcctcgaaaactacaacacccaaatctttaagatcactagcctcgacctccagaggtccgaacagaagaacctcaaggggcacaccaggatctggaacaggttctggaccaagcagaacgaggagatcaactacaacctcagactcaatcccgagatcgcaatcgtctggagaaaggccaagaaaaccagaatcgagaagtacggggagagatccgtcctctacgaacccgagaaaaggaacaggtatctccacgagcagtacaccctctgcaccaccgttactgacaatgcactcaacaacgaaatcacctttgccttcgaggacaccaaaaagaagggcaccgaaatcgtcaagtataacgagaagatcaaccagactctcaagaaggagttcaataagaaccaactctggttctatgggatcgacgccggcgagattgagctcgcaacactcgccctcatgaataaggacaaggagccccagctcttcaccgtctacgagctcaagaagctcgacttcttcaagcacggctacatctacaacaaagagagagagctcgtgattagggagaagccatataaagccatccagaatctttcctatttcctcaacgaagaattgtacgagaagacattcagggacgggaagttcaacgagacctacaatgagctctttaaagaaaagcacgtttccgccatagacttgactaccgccaaggttatcaacgggaagatcatcttgaacggggacatgatcacctttctcaacctcagaatcctccacgcacagaggaagatctacgaggagttgatcgaaaacccccacgccgaactcaaggagaaggactataagctctatttcgaaatcgaggggaaggacaaagacatctacatcagcaggctcgactttgaatacatcaaaccataccaggagatcagcaattacctcttcgcctacttcgccagccaacagataaatgaggccagggaggaggaacagatcaaccagaccaagagggccctcgccggaaacatgatcggcgtgatctattacctctaccagaagtacagggggatcatctccatcgaggatcttaaacagaccaaggtcgaatccgacaggaacaaattcgaagggaacatcgagaggcctctcgagtgggccctttacagaaagttccagcaggagggttacgttccccccatcagcgagttgatcaagctgagggagctcgaaaaattccccctcaaagacgtgaaacagccaaagtacgagaatattcagcagtttggcatcatcaagttcgtctctcccgaggaaacctccaccacctgccccaagtgcctcaggagattcaaggactacgacaagaacaagcaggaggggttttgcaaatgccagtgtggattcgatacaaggaacgatctcaagggattcgagggcctcaacgaccccgacaaggtcgccgccttcaatatcgcaaagagggggttcgaggacttgcaaaagtacaag

SEQ ID NO: 64 - DNA, 3192 bp, Artificial
  synthetic
atggagaagtacaagatcaccaagactatcagattcaagcttctccccgacaagatccaggacatttcaaggcaagttgccgtcctccagaactccacaaacgccgagaagaagaacaacttgctcaggctcgtgcagagaggacaggagttgcccaagctccttaacgagtacatcaggtactcagacaatcacaagttgaagagcaacgttacagttcacttcaggtggctcaggttgttcaccaaggatttgttctataactggaagaaggacaacacagaaaaaaagatcaagatcagcgacgtcgtgtacctctcacacgtcttcgaggccttcctcaaggagtgggaatccaccatcgagagggttaacgccgattgcaacaagcccgaggagtccaaaactagagacgcagagatcgcactttctatcagaaagctcggcatcaaacaccagctcccattcatcaaagggttcgttgataatagtaacgataagaacagcgaggacaccaagtcaaaattgaccgccctcctcagtgagttcgaggccgtgctcaagatatgcgagcaaaactacctccccagtcagtcttccggtatcgccatcgccaaggcctcctttaactattacaccataaacaagaagcagaaggacttcgaggccgaaatcgttgccctcaagaagcaactccacgccagatacggtaacaaaaagtacgatcaactcttgagggagctcaaccttatcccattgaaggaactcccactcaaggagcttcccctcatagaattctactccgagatcaagaagaggaagtccaccaagaagagtgagtttctcgaggccgtcagcaacggcctcgttttcgacgacctcaagagcaagtttcctctcttccagacagagtccaataagtacgatgagtaccttaagctctccaacaagattacccagaaatcgaccgcaaaatccctcctctccaaggactctcccgaggcccagaagctccagaccgagataacaaagcttaagaagaacaggggagagtactttaagaaggccttcggcaaatatgttcagctttgcgagctctataaggagatcgctggcaagagaggtaagctcaagggccaaatcaaggggatcgaaaatgagagaatcgactcccagagactccaatactgggcccttgtgctcgaggacaacctcaagcatagcttgatcctcatccccaaggagaagaccaacgaactctatagaaaagtctggggcgccaaggacgacggcgccagcagctcttccagctccactttgtactatttcgagagcatgacctacagggccctcagaaagctctgcttcggcatcaacgggaatacattcctccccgagattcagaaggaactccctcaatataaccagaaggagttcggagagttctgcttccataagtccaacgatgacaaagaaatcgacgaacccaagcttataagtttctaccagagtgtgttgaagaccgacttcgtgaagaataccctcgccctccctcagtctgtgttcaacgaggtcgccattcagagcttcgaaactaggcaggacttccagatcgccctcgaaaagtgttgttacgcaaagaagcaaatcatcagcgagagcctcaagaaagagatcctcgagaattacaatacacagatcttcaagattacctcactcgacctccaaaggtcagagcagaagaaccttaagggccacaccaggatctggaataggttctggaccaagcagaacgaggagatcaactacaatctcagacttaatcccgagatcgccatcgtgtggaggaaggcaaagaagaccaggatcgagaagtacggcgagaggagcgtcctttatgagcccgaaaagaggaacaggtacctccacgagcagtacaccctctgcaccaccgtgaccgacaacgccctcaataatgaaatcaccttcgcattcgaggataccaagaagaagggaaccgagatcgttaagtacaacgagaaaatcaaccagaccctcaaaaaggagttcaacaaaaatcaactttggttctacgggatcgacgccggggaaatcgagctcgccacactcgccttgatgaacaaggacaaggaaccccagctctttaccgtctacgagctcaagaagctcgacttcttcaagcacggttacatctacaataaggagagagaactcgttatcagggagaaaccctacaaggccatccagaacttgtcctacttcctcaacgaggaactctacgagaagaccttcagggacgggaagttcaatgagacctacaacgagctctttaaggaaaaacacgtctccgctatcgatctcaccaccgccaaggtgatcaacggcaagatcattctcaacggtgatatgatcacattcctcaatctcaggatccttcacgcccagcgtaagatctacgaggaacttatcgagaacccccatgccgagctcaaagaaaaggattacaagctttacttcgagatcgaggggaaggacaaagacatctacatctccaggctcgactttgagtacatcaagccctaccaggagatcagcaactacttgttcgcctacttcgcctcacagcagatcaacgaagcaagggaggaggagcaaatcaaccagaccaaaagggccctcgcaggtaacatgataggggtcatctactacttgtaccagaaatacagaggcatcatcagtatcgaggacctcaagcagactaaggtggagagcgacaggaacaagttcgaaggcaatatcgagagacccctcgagtgggccctctacagaaaattccagcaggagggctacgtgccccccatcagcgaattgatcaagctcagggagctcgagaagtttcccctcaaggatgtgaagcagcccaagtacgagaacatccaacaattcggcatcatcaaattcgtgtcacccgaggagacctccaccacctgccccaagtgcctcaggaggttcaaggactacgacaaaaataagcaagaggggttctgcaaatgtcaatgcgggttcgacaccaggaacgacctaaagggcttcgagggtttgaatgaccccgacaaggtcgcagcattcaacatcgccaagaggggcttcgaggacctccagaagtataag

SEQ ID NO: 65 - DNA, 3192 bp, Artificial
  synthetic
atggagaagtacaagataactaagaccatcaggttcaagctcctccccgacaagatccaggacatctcaagacaagtggccgtgttgcagaactccactaatgccgagaaaaagaacaacttgctcaggttggttcaaaggggccaggagctccccaagcttctcaacgagtacatcaggtactccgataaccacaagctcaagagcaacgttaccgtccacttcaggtggctcaggctcttcaccaaagacctcttttataactggaagaaggacaacaccgagaagaagataaagatcagcgatgttgtttacttgagtcacgtcttcgaagccttccttaaggagtgggaatctaccatcgagagggtgaatgccgattgcaataaacctgaagagtccaaaaccagggacgctgagatcgccctctctatcaggaagctcgggatcaagcaccaactcccctttatcaaggggttcgtcgataacagcaacgataagaacagcgaagacactaaatccaaactcaccgccctcctctccgagttcgaggccgtgctcaagatttgcgagcagaactaccttcccagccaatccagcggcatcgccatcgccaaggcttccttcaactactacaccatcaataagaagcagaaggacttcgaagccgaaatcgtcgcactcaagaagcaactccatgcaagatacgggaataagaagtacgaccaactccttagggagctcaacctcatccccctcaaggagctccctctcaaggagttgcctctcatcgaattctacagcgagatcaagaaaaggaagtctactaagaagagcgagttcctcgaagccgtgagcaacgggctcgtgttcgacgacctcaagtctaagttcccactcttccagactgagagcaataagtacgacgagtacctcaagctcagcaacaagatcacccaaaagtctaccgccaagagtctcctttccaaggatagccccgaagctcagaagctccagaccgagatcactaagctcaagaagaacaggggcgagtatttcaagaaggcctttggcaagtacgtgcagctctgcgagctctacaaagagatcgccggcaagagggggaaactcaaggggcaaataaagggcatcgaaaatgagaggatcgatagtcaaaggctccagtactgggccctcgttttggaagacaacctcaagcactcactcatcctcatccccaaggagaagactaacgaactctacaggaaggtttggggcgccaaggacgacggggccagctcctcaagctcctccaccctctattatttcgagagcatgacctacagggccctcaggaagctctgcttcggcatcaacgggaacaccttcctccccgaaatccagaaggagctcccccagtataaccagaaggaattcggggagttctgttttcacaagagcaatgacgataaagagatcgacgaaccaaaactcatcagcttttaccagagcgttttgaaaacagacttcgtgaaaaacactcttgccctcccacagtctgtttttaacgaggtggccatccaaagttttgagaccaggcaggacttccagatcgcactcgaaaagtgctgctacgctaagaagcagatcatctctgagtcactcaagaaggagatccttgaaaactacaacacccaaatctttaagatcaccagcctcgacctccagaggtccgagcagaagaacctcaaagggcataccaggatttggaacagattttggacaaagcagaacgaggagatcaactataatttgaggctcaaccccgagattgccattgtctggagaaaggccaagaagaccaggatcgagaaatacggcgagaggtccgttctttacgagcccgagaagagaaataggtacctccacgagcagtacacactctgcaccaccgttactgataacgctctcaacaacgagataaccttcgccttcgaagatacaaagaagaaggggaccgagatcgtgaagtacaacgaaaaaatcaatcaaacactcaagaaggagttcaacaagaaccaactctggttctatgggatcgacgccggagagatcgaacttgccaccctcgccctcatgaataaagataaggagccacagctcttcaccgtttacgagttgaagaagttggacttcttcaagcatgggtatatctacaacaaggagagggagctcgtgataagagagaagccctataaagccatccagaatctctcctatttcctcaacgaggaactctacgagaagacatttagggacgggaagttcaacgagacttataatgagctttttaaggagaagcatgtgagcgccattgatctcaccaccgccaaagtgatcaatgggaagatcatcctcaacggcgacatgatcaccttcctcaacctcagaatcctccacgcacaaaggaaaatatacgaggagctcatcgagaacccacacgccgagcttaaggagaaggattacaagctttattttgaaatcgagggtaaagacaaagacatctacatcagcaggcttgatttcgaatatatcaagccctaccaggagattagtaactacctctttgcctacttcgccagccagcaaataaacgaggcaagagaggaggagcagatcaaccagaccaagagagctctcgccggtaacatgatcggggtgatttactatctctaccagaaatacagggggatcatctccatcgaggacctcaaacagactaaggtggaatccgacaggaataagttcgaagggaacatcgagaggcccctcgagtgggctctctacaggaagtttcaacaggagggttacgtgcctcccatatccgaacttatcaagttaagggagctcgaaaagttcccccttaaggacgttaagcagcccaagtatgagaacatccagcagttcgggatcatcaaattcgtcagccccgaggagacttccaccacctgccctaagtgtctcagaaggttcaaggattacgacaaaaataagcaggagggcttctgcaagtgccagtgtggcttcgacaccagaaacgacttgaaagggttcgaggggcttaatgaccccgacaaggtcgccgccttcaacatcgccaagaggggcttcgaggacctccaaaagtacaaa

SEQ ID NO: 66 - DNA, 3192 bp, Artificial
  synthetic
atggagaaatacaaaatcaccaagaccatcaggtttaagcttctcccagacaaaatccaagacatatcaagacaggttgccgtgttgcagaacagcaccaacgccgagaagaagaacaacctcctcagattggtgcagaggggccaagaactccccaaactcctcaacgagtacatcaggtactcagacaaccacaaactcaagagtaatgtcacagtccacttcaggtggctcaggctctttaccaaggacctcttctataactggaagaaggacaacaccgagaagaaaatcaaaatcagcgacgtggtctacctcagccatgtctttgaggccttcctcaaggagtgggaaagcaccatagagagagttaacgccgactgcaacaagcccgaggagtccaagactagggacgccgagatcgctcttagcatcagaaaactcggcattaaacatcagctccccttcataaaaggattcgtggataactccaacgacaagaacagcgaggacaccaagtccaagctcaccgccttgctcagcgaattcgaagccgttctcaagatctgcgagcagaactatctccccagtcagagtagtggaatcgccatcgccaaggcctccttcaactactataccatcaacaaaaagcagaaggacttcgaagcagagatcgtcgccctcaagaaacagctccacgccagatacgggaacaagaaatacgaccagctcctcagggagttgaacttgattccccttaaagaactccccctcaaggagttgcctctcatcgagttctactccgagatcaagaagaggaagagtactaagaaatccgagtttcttgaggccgttagtaacggactcgtcttcgacgacttgaagtccaaattccccctcttccagaccgagtccaacaagtacgacgagtacttgaagctctccaataagatcacccagaagtctaccgccaaaagcctcctttcaaaggattcccccgaggcccagaaactccagactgagatcactaagctcaagaagaacaggggcgagtacttcaagaaggccttcggcaagtatgtgcagctctgcgagctctacaaggagatcgccggcaagagggggaaactcaaggggcagatcaagggcatcgagaatgagagaatcgactcccaaaggctccagtactgggccttggttttggaggacaacttgaagcactccttgatcctcatccctaaagaaaagaccaacgagctctacaggaaagtttggggggccaaagacgacggcgcctcctcatccagtagcagcaccctctactacttcgagagcatgacctatagggcactcaggaagttgtgtttcgggatcaacggtaacacattccttcccgagatccagaaggagcttccccagtacaatcagaaggagttcggggagttctgcttccacaagagcaacgacgacaaggagatcgacgagcctaagcttatctcattctaccagagtgttctcaaaacagatttcgtgaagaacaccctcgctctcccccagagcgtcttcaacgaagtggccattcagtccttcgagaccagacaggacttccagatcgccttggagaaatgctgctacgccaagaaacaaatcatatcagagtccctcaagaaagagatccttgaaaattacaacacacaaatcttcaagataaccagcttggacctccagaggagtgagcagaagaacctcaaggggcacaccagaatctggaacaggttctggacaaagcagaacgaggaaatcaattacaacctcaggcttaaccccgagatcgctatcgtgtggaggaaggccaagaaaacaaggatcgagaaatacggcgagaggagcgtgctctatgagcccgagaagaggaataggtacctccacgaacaatacaccctctgcaccaccgtgaccgacaacgcccttaataatgagattaccttcgccttcgaggataccaagaaaaaagggaccgagatcgtgaagtacaacgagaagatcaaccagacccttaagaaggagttcaacaagaaccagctctggttctacgggatagatgccggggagattgagctcgccaccctcgccctcatgaacaaggacaaggagccccagctcttcaccgtgtatgagcttaagaagcttgacttcttcaagcatggctatatctacaacaaggaaagggagctcgtgatcagggagaaaccatataaggccatccagaatctcagttacttcctcaacgaggagctctatgagaagaccttcagggatggcaagttcaacgagacctataacgagctctttaaagagaagcacgtgtccgccatcgacctcaccaccgccaaggtgatcaacgggaagataatcctcaacggagacatgatcacctttctcaaccttaggatcctccacgcccagaggaagatctacgaggaactcatcgagaaccctcacgccgagttgaaggagaaggattataagctttattttgagatcgaggggaaagacaaagatatctacatcagcagacttgatttcgagtatattaagccctatcaggagatcagcaactacttgtttgcctacttcgcttcccaacagatcaatgaggccagggaggaggagcagatcaaccagaccaagagggccctcgccggtaacatgatcggggtgatctattacctctaccagaagtacagggggattatctccatcgaggacctcaaacagaccaaggttgagtccgacaggaacaagttcgagggcaacatcgagagaccactcgagtgggccctctacagaaagtttcagcaagaggggtacgtcccccccataagcgagcttatcaagctcagggagctcgagaagtttccactcaaggacgtcaagcagcccaaatacgagaacatccagcagtttgggatcattaagttcgttagccccgaggaaaccagcacaacctgccccaaatgcctcaggagatttaaagactacgacaagaacaagcaggagggattctgcaagtgccagtgtggtttcgacaccaggaatgacctcaaagggttcgagggcctcaacgaccccgacaaggttgccgccttcaatatagccaagaggggcttcgaggacctccagaagtataaa

SEQ ID NO: 67 - DNA, 3192 bp, Artificial
  synthetic
atggagaagtacaagatcacaaaaaccattaggtttaagctccttcccgacaaaattcaggacatctccagacaggttgcagtcctccagaactctaccaacgcagagaagaagaacaatctcctcagactcgtccagaggggacaggagctccccaagctcctcaatgagtacatcaggtactccgacaaccacaagctcaagtccaacgtgactgttcatttcaggtggttgaggctcttcaccaaggacctcttctataactggaagaaggacaacaccgagaagaagatcaagatcagcgacgtcgtgtacctctcccatgtctttgaggccttccttaaggagtgggagagcacaatcgagagagttaacgctgactgtaacaagcccgaggaatccaagaccagggatgccgaaatcgccttgagcataaggaaactcggcatcaagcaccaactccccttcataaaggggtttgttgacaattccaatgacaagaactctgaggacaccaagtctaaactcaccgcccttctcagcgagttcgaagccgtgctcaagatctgcgagcagaactatctcccctctcagtcctctggcatcgccatagccaaggcctccttcaactactacaccatcaacaagaaacagaaggacttcgaggcagaaatcgtggccctcaagaaacagctccacgccaggtacggtaacaaaaagtacgaccaactcctcagggagctcaacctcatcccactcaaggaactccctctcaaagagttgccccttatcgagttctactccgagatcaaaaaaagaaaaagtactaagaaatctgagtttctcgaagccgtgtccaatgggcttgttttcgacgacctcaagtccaagttccccttgtttcagactgaaagcaacaaatacgacgaatacctcaagttgtctaacaagatcacccagaagagcaccgctaaaagccttctctccaaggactcccccgaggcccaaaaactccagaccgagatcaccaagctcaagaagaacaggggcgagtatttcaaaaaagcattcggcaagtacgttcagttgtgcgaactctacaaagagattgcaggcaagagggggaagctcaaggggcagataaaaggaatcgagaacgagagaattgattcccaaaggctccagtactgggcacttgtcttggaagacaacctcaagcactccttgatcctcatacccaaggagaagaccaacgaactctacaggaaggtgtggggtgccaaagatgacggcgctagcagcagttcctcctccaccctctactacttcgagagcatgacctacagggccctcaggaagttgtgcttcggcattaacggcaacacattcctccccgagatacaaaaagagctcccccagtacaaccagaaagagtttggggagttctgcttccacaagtccaatgacgacaaggagatcgacgagcccaagctcatcagcttctaccaaagcgtcctcaagaccgactttgtcaaaaacaccctcgccttgccacagagcgtgttcaacgaggttgccatacagagtttcgagaccagacaggacttccagatcgcactcgagaagtgctgttacgccaagaagcaaataatcagcgaatcccttaagaaggaaatacttgagaactacaacacccagatcttcaaaatcacctccctcgacctccagaggtcagaacagaagaacctcaagggccatacaaggatctggaataggttttggaccaaacagaatgaggagatcaattataatctcaggctcaaccctgagatcgccatcgtctggagaaaggccaagaagactagaatcgagaagtacggcgagaggtccgttctctacgaacccgaaaagaggaacaggtaccttcacgagcagtacaccttgtgcaccaccgtgaccgataatgccctcaacaacgaaatcacctttgcattcgaggataccaaaaagaaggggaccgagattgtcaagtacaacgaaaagattaatcagacccttaagaaggagtttaataagaaccaactctggttctacggcatcgatgccggcgagatcgagcttgccacactcgccctcatgaacaaggacaaggagccccagcttttcactgtttatgagctcaagaagctcgatttcttcaagcacgggtacatctacaacaaggaaagggagctcgtgatcagggagaagccctacaaggccatacagaacctctcctacttcctcaacgaagagttgtacgagaagaccttcagagatgggaaattcaacgaaacctacaacgagctcttcaaagagaagcacgtgtccgccatcgacctcaccaccgccaaggttatcaacggaaagatcatccttaatggtgatatgatcacattcctcaatctcagaatcctccatgcccagaggaagatctacgaggaacttatcgagaatccccacgccgagctcaaggagaaagactacaagctctattttgagatcgaggggaaagacaaagacatctatatctccagactcgacttcgagtatatcaaaccataccaggagatctctaactacttgtttgcctactttgccagccagcagatcaatgaagccagggaggaagaacaaattaaccagaccaaaagggcactcgcaggcaacatgatcggggtgatctactatttgtaccagaagtataggggaataatcagcattgaggatttgaagcagaccaaggtggagtccgacagaaataagttcgagggcaatatcgagagacccttggagtgggccctttataggaaattccagcaagaggggtacgttccccccatctccgagctcatcaagctcagggagctcgaaaagttccccctcaaggacgttaagcagcctaagtatgagaacatccaacaattcggcatcatcaagtttgtctcccccgaagagacttctaccacctgccccaagtgtcttaggaggtttaaggactatgacaagaacaagcaagagggtttctgcaagtgccagtgcgggttcgataccaggaacgatctcaaggggttcgaaggcctcaatgaccccgataaggtggcagccttcaacatcgccaagagaggattcgaggatctccagaagtacaaa

SEQ ID NO: 68 - DNA, 3192 bp, Artificial
  synthetic
atggaaaaatacaagatcaccaagaccatcaggttcaaacttctccccgataagatacaagacatttcaaggcaagtcgccgttctccagaacagtaccaacgccgaaaagaagaacaacctcttgaggctcgtccaaaggggccaggagctcccaaagctcctcaacgagtacattaggtatagcgataaccacaagctcaagtcaaacgtgaccgtccacttcaggtggttgagactcttcaccaaggacctcttctacaactggaagaaggacaacaccgaaaagaagattaagatatcagacgtggtgtatttgagccatgttttcgaggcattcctcaaggagtgggagagcacaatcgagagagtgaacgccgactgcaacaaacccgaggagagcaagaccagggacgccgaaatcgccctcagcatcaggaagctcggcatcaagcaccagctccccttcatcaagggtttcgtcgacaacagcaatgacaagaatagcgaggataccaagtccaaattgaccgccctcctctccgaattcgaggctgtcttgaaaatatgtgagcagaactatctcccctcccagagctccggcattgccatcgccaaggcaagcttcaactactacaccatcaacaagaagcaaaaagactttgaggccgagatagtggccctcaaaaaacagctccatgcaaggtacggcaacaagaagtatgaccagctcctcagagagctcaacctcatccccctcaaggaactccccctcaaggagctccccctcatcgaattctactcagagatcaaaaagaggaagtccaccaagaaaagcgagttcctcgaggccgtctccaacgggctcgtgttcgatgacctcaagtccaagttccccctcttccagaccgagagcaataagtacgatgagtacctcaaactctccaacaaaatcactcagaaaagtacagctaagagtcttctctccaaggactcccccgaggcacagaagctccagaccgagatcaccaagctcaagaagaacagaggggagtatttcaagaaagccttcggcaaatacgttcagctctgcgaactctacaaggagatagctgggaaaaggggcaaactcaagggccagatcaaggggattgagaatgagaggatcgattcccagaggctccaatattgggctctcgtgctcgaggacaatcttaagcactcactcatcttgatccccaaggagaagacaaacgagctctacaggaaggtctggggggccaaagatgatggtgcaagcagctccagcagttccaccctctactacttcgaatccatgacatatagggccctcagaaaactctgcttcggcattaacggcaatacattcctccccgagatccagaaggagctcccccagtacaaccagaaggagttcggcgagttttgcttccacaaatccaacgacgataaagagatagacgagcccaagctcataagcttctaccagtccgtgctcaagaccgatttcgtgaagaacaccctcgccctcccccaatctgtctttaacgaggtggccatacagagcttcgagaccaggcaggacttccagatcgccctcgagaaatgttgctacgctaagaagcagatcatcagtgaaagcctcaagaaggagatcctcgagaactataatacccagatctttaaaatcacctccctcgacctccagaggtcagagcaaaagaatctcaagggtcacaccaggatctggaacaggttctggactaaacaaaacgaggagatcaattacaacctcaggttgaaccccgagatcgccattgtctggagaaaagccaagaaaaccaggattgagaagtatggggagaggtctgtcctctatgagcctgaaaaaagaaacaggtatctccatgaacagtacaccctctgtaccaccgtcaccgacaacgccctcaacaacgagatcaccttcgcattcgaggacaccaagaagaagggaaccgagatcgtgaaatacaatgagaaaatcaaccagaccctcaagaaagagtttaacaaaaaccaactctggttctacgggatagacgccggcgagatcgaacttgccaccctcgccctcatgaacaaggataaggagccccagctctttactgtttatgagctcaagaagctcgacttcttcaagcatgggtacatctacaacaaggaaagggagctcgtgatcagggaaaagccctacaaagccatccaaaatcttagctatttccttaacgaggaattgtacgagaagaccttcagggacggcaagttcaatgagacctacaacgagctcttcaaagagaagcacgtttccgccatcgatctcacaaccgccaaggttatcaacgggaagatcattctcaatggcgacatgatcacattcctcaatctcaggatcctccacgcccagaggaagatctacgaggagttgatcgagaacccccacgccgagctcaaggagaaggactataagctttacttcgaaatagagggcaaagataaagatatctacatctccagactcgacttcgagtatatcaagccctaccaggagatctccaactacctctttgcctacttcgcgagccaacaaattaatgaggccagagaggaggagcagatcaaccagaccaaaagggccttggccggcaatatgatcggagttatctactatctctaccagaagtacaggggcatcatcagcatcgaggacctcaagcaaaccaaggtcgagagtgataggaacaaattcgagggcaacatcgagaggcctctcgagtgggccctctacaggaagttccagcaggaggggtacgtcccccctataagcgaactcatcaagctcagggagctcgaaaaatttcccctcaaggacgttaagcagcccaaatacgaaaacatccagcagttcgggatcatcaagttcgtgtcccctgaagagaccagcacaacatgtcccaagtgcctcaggaggttcaaggactacgacaagaataagcaggagggcttttgcaagtgccagtgtggtttcgataccaggaacgacctcaaaggatttgagggcctcaacgatcccgataaggtcgccgccttcaacatcgccaagaggggctttgaggacctccagaagtataag

SEQ ID NO: 69 - DNA, 3192 bp, Artificial
  synthetic
atggagaagtacaaaatcaccaagactataaggtttaagctcctccccgacaagatccaggacatcagcagacaagtggccgtgctccagaatagcaccaacgccgagaagaagaataacctcctcaggctcgttcaaagggggcaggagctcccaaagctcctcaacgagtacatcaggtacagcgataaccacaagttgaagtccaacgttaccgttcactttagatggctcaggctcttcaccaaggacctcttctacaattggaaaaaggacaacaccgagaaaaagatcaagatcagcgacgtggtgtacctcagccatgtcttcgaggccttcctcaaggagtgggagagcactatcgaaagggtcaacgccgactgtaataaaccagaggagagcaagactagggacgccgaaattgctctctccatcaggaagctcggtatcaagcaccagctccctttcatcaagggattcgtcgacaactccaacgataagaacagtgaggacaccaagagtaagcttaccgcactcctcagtgagttcgaggccgttctcaagatctgcgagcaaaattacctcccctcacagtcttctggcatcgccatcgccaaggcatcattcaactactacaccatcaacaagaagcaaaaagacttcgaagccgagatcgtggccttgaagaaacaactccacgccaggtacggcaacaagaagtacgaccagttgctcagggagcttaatctcatccccttgaaggagctccccctcaaggagttgcccctcattgagttctactccgagattaagaagaggaagtccacaaagaaatccgagtttctcgaagccgtcagcaacgggctcgtcttcgacgatctcaagtcaaagttcccactcttccagactgagtccaacaagtacgacgagtacctcaagttgtctaacaagataacccagaagtccacagccaagtcattgctctccaaagattccccagaagcccagaagctccagaccgaaataacaaagctcaaaaagaacaggggcgaatacttcaaaaaagccttcggcaagtacgttcaattgtgtgagctctacaaggaaatcgctggcaaaagaggaaaattgaagggtcaaataaaaggaatcgaaaacgaaaggatcgatagtcagagactccaatactgggcccttgtgctcgaggacaatctcaagcactccctcatcctcatacccaaggagaagaccaacgagctctacagaaaggtgtggggcgctaaagatgacggggctagtagctccagctccagtaccctctattactttgagagcatgacctacagagctctcaggaaactctgcttcggcatcaatggaaacactttcctcccagagatccagaaggagctcccccagtacaatcaaaaggagttcggagagttctgcttccacaagagcaacgacgataaggaaatcgacgagcccaagctcatcagtttctatcagagcgtgttgaagacagactttgtcaagaacaccctcgcactcccccagagcgtcttcaacgaggtggccatacaatccttcgagaccaggcaggactttcagattgctctcgaaaagtgctgttatgctaagaagcagatcatcagcgagtccctcaagaaggagatcctcgagaactacaatacacagatcttcaagatcaccagcctcgacttgcagagatctgagcagaagaaccttaaggggcacaccaggatatggaacaggttttggacaaaacagaatgaggagatcaattacaatttgaggcttaatcccgagatcgctatcgtgtggaggaaggccaagaagaccaggatcgagaagtatggagagagatcagttctctacgagcccgagaagaggaacagatacctccacgagcagtataccctctgcactaccgtgaccgacaatgccctcaacaatgagatcacctttgcatttgaagacaccaaaaagaaggggaccgaaatcgtgaagtacaacgagaagatcaaccagacactcaagaaggagtttaacaaaaaccaattgtggttttacggcatcgacgccggggagatcgagctcgccaccttggccctcatgaacaaggacaaggagccacagctcttcaccgtgtacgagcttaagaaactcgatttcttcaaacacggttacatctacaataaggagagagaactcgtcatcagggagaagccctacaaggccattcagaacctctcctatttcctcaacgaggagctctacgagaagaccttcagggacgggaagttcaacgagacctacaatgagctcttcaaggagaagcacgtttccgctatcgacctcaccaccgccaaggtgatcaacgggaagatcatcttgaatggtgacatgatcaccttccttaatctcagaatcctccatgcccagagaaagatctacgaggagctcatcgaaaacccccacgccgaactcaaggaaaaggactacaagctctactttgaaatagagggaaaagacaaagatatctacatctccaggctcgacttcgaatacatcaagccctaccaagagatcagcaattacctctttgcctacttcgcaagccaacagataaatgaggccagggaagaggaacagatcaaccagacaaagagggccctcgccgggaacatgatcggtgtgatatactacctctatcagaagtataggggcatcatctccatcgaggacttgaaacagacaaaagtggaatctgataggaacaaatttgaggggaatatcgagaggccccttgagtgggccctctacaggaaatttcagcaggaagggtacgttccaccaatcagcgaacttatcaaactcagggagctcgaaaagtttcccctcaaggacgtgaaacagcccaagtacgagaacattcaacaatttggcataatcaaatttgtcagccccgaggagacctccaccacctgccccaagtgcctcagaaggttcaaggattacgataagaacaagcaggagggcttctgtaagtgccagtgcggcttcgataccaggaacgacctcaaggggttcgaggggctcaatgaccccgacaaggtcgccgccttcaatatcgccaaaagaggcttcgaggacctccagaagtacaag

SEQ ID NO: 70 - DNA, 3192 bp, Artificial
  synthetic
atggaaaagtacaagatcaccaagaccatcaggttcaagttgctccccgacaaaatccaagacatctccaggcaagttgccgtgctccaaaactcaaccaacgccgaaaagaagaacaacctccttaggctcgttcagaggggtcaggaactccccaagctcctcaacgagtatatcaggtacagcgataaccacaagctcaagtccaacgtcacagtgcacttcagatggctcaggttgttcaccaaagatcttttttataactggaagaaggacaacaccgagaagaaaattaagatcagcgacgtcgtgtatctcagccacgtttttgaggccttcctcaaggagtgggagagcaccatcgagagagtgaatgccgactgcaacaaacccgaggagtccaaaaccagagacgccgagatcgccctcagcatcaggaagctcggcatcaagcatcaacttccctttatcaagggctttgttgacaactctaacgacaagaacagcgaggacaccaagagcaagctcactgccctcctctccgagttcgaagccgttctcaaaatttgcgagcagaattacctccccagtcagtcctccgggatcgctatcgcaaaggccagctttaactactacacaatcaacaagaagcagaaggacttcgaggctgagatcgtcgccctcaagaagcagctccacgccaggtacggcaataagaagtacgaccagctcctcagggaacttaacctcatacctctcaaagagctccccctcaaggagctccccctcatagagttctactccgagatcaagaagaggaagagcaccaaaaaaagtgagttcctcgaggctgtctccaacggtttggtgttcgacgacttgaagtccaagttccccctttttcagaccgaatctaacaagtacgacgaatacctcaagctctccaataagatcacccaaaagagtaccgcaaagagccttctcagcaaggacagccctgaagctcaaaagctccagaccgagatcaccaagctcaagaaaaacaggggcgagtacttcaagaaagcctttggcaagtacgttcagctctgtgagctctacaaggagatcgccgggaaaagggggaaactcaagggtcagatcaagggcatagaaaacgagaggatagactcccaaaggcttcaatactgggccctcgtcctcgaggacaacctcaaacactccttgatcttgatccccaaggagaagaccaacgagctctatagaaaggtttggggggccaaggacgacggggccagctcttctagctccagtacactctattatttcgagtccatgacttatagggcactcaggaaactctgcttcggcatcaacgggaacaccttcctccccgagattcagaaggaattgcctcaatacaaccagaaggagttcggcgagttttgcttccacaagtccaacgatgacaaggagatcgacgaacccaagcttatctccttttaccagtccgtcctcaagacagactttgttaaaaatactctcgccctcccacagagcgtgttcaacgaggttgccatccagagcttcgagacaaggcaggatttccagatcgcccttgagaagtgttgttacgctaagaaacagatcattagcgagagtctcaagaaagagatcctcgagaactacaacacacagattttcaagatcacctccctcgatctccagagatccgagcaaaagaatctcaaggggcacaccaggatctggaacaggttctggaccaagcaaaacgaagagatcaactacaatctcaggctcaatcccgagattgctatagtgtggaggaaagcaaagaaaaccaggatcgagaaatacggggagagatctgttctctacgaacccgagaagaggaataggtacttgcacgagcagtacactttgtgtaccactgtgaccgacaatgccctcaacaacgagataacattcgcatttgaggacaccaaaaagaaagggactgaaatcgtgaagtacaacgagaagattaaccagaccctcaagaaggagttcaataagaaccagctctggttctacgggatcgacgcaggcgagatagagcttgccacccttgcactcatgaacaaggataaggagccccagctcttcacagtgtacgagttgaagaagctcgattttttcaagcacgggtacatctacaacaaggaaagggaactcgtcatcagggagaagccatacaaagccatccagaatctctcctattttctcaatgaagagctctatgagaagaccttcagagacggcaagtttaacgagacctacaatgagctcttcaaggagaagcacgtttccgccatcgacctcaccacagccaaggtgatcaacggtaaaatcatcctcaacggcgatatgatcaccttcctcaacctcaggatcttgcacgcacagaggaagatctacgaggaactcatcgaaaacccccatgcagaactcaaggagaaggactacaagctctatttcgagatcgaggggaaagacaaggacatctatatcagtaggctcgatttcgagtacatcaagccttatcaagagatcagtaactacctctttgcctacttcgcctcccagcaaatcaacgaggccagggaggaagagcagatcaaccagactaaaagggcccttgctggtaacatgatcggggttatatactacctttaccagaaatacaggggtattatctccatcgaggatctcaagcagaccaaggtcgagtctgacagaaacaaattcgagggcaacatagaaaggcccctcgaatgggctctttacaggaagttccagcaggagggatacgtcccccccatcagtgagctcatcaaactcagagagttggagaagtttccccttaaagatgtcaagcagcccaaatacgagaacatccaacaattcgggatcatcaagttcgtgagccccgaggagacctctaccacctgtcctaagtgccttaggaggtttaaggactatgacaagaacaagcaggagggtttctgcaagtgtcagtgcgggttcgacacaaggaacgacctcaagggctttgagggcctcaacgaccccgacaaagttgccgccttcaacatcgccaagaggggcttcgaggatttgcagaaatacaag

SEQ ID NO: 71 - DNA, 3192 bp, Artificial
  synthetic
atggagaagtacaagatcactaaaacaattaggttcaaacttctccccgataagatccaggacatctccaggcaggtcgccgtgctccaaaatagcaccaacgctgaaaagaaaaataaccttctcaggctcgttcaaagaggccaggagctccccaagcttctcaacgagtacatcaggtacagtgacaatcataagctcaagagcaacgtgactgttcatttcagatggctcaggttgtttaccaaggacctcttttacaattggaaaaaggataacaccgagaagaaaatcaagatatctgacgtggtctacctcagtcatgtttttgaagccttcctcaaagaatgggagtccactattgagagagtgaatgccgactgcaataagcccgaagaatccaagaccagggacgccgagattgccctctcaatcaggaagctcgggatcaagcaccagttgcccttcatcaaaggcttcgtcgacaacagtaacgataagaattctgaagacactaagagcaagttgaccgccctcctcagcgagtttgaggccgtgctcaaaatatgcgagcagaattacttgccctcccagagctccggcatcgccatcgccaaagccagctttaattattataccatcaacaaaaaacaaaaggatttcgaggccgagatcgtcgccctcaagaagcaactccacgccaggtatggaaacaaaaagtacgatcagctcctcagggagctcaacttgatccccctcaaggagcttccattgaaggagctcccccttatcgagttctacagcgagatcaagaagaggaagagcaccaaaaagagcgagttcctcgaggccgtttccaacgggcttgtcttcgacgatttgaagagtaagtttccccttttccagaccgaatccaacaagtacgacgaatatctcaagctcagcaacaagatcacacaaaagagcaccgctaagtccctcctctccaaggacagccccgaggctcaaaagctccagaccgagatcaccaagctcaagaagaataggggcgaatacttcaagaaggcctttggcaagtacgttcagctctgcgagctctacaaggagatcgcaggcaagaggggaaaactcaagggccaaattaaggggatagagaacgagaggatcgatagccagaggctccagtattgggccctcgtgctcgaggataacctcaagcacagcctcatcctcatccctaaggagaagaccaacgagctctacaggaaggtgtggggtgctaaggacgacggcgcttcctcatccagttccagcaccctctactactttgagtccatgacatacagggcccttaggaagctctgctttgggatcaacggcaatactttcctccccgagattcagaaggagctcccacagtacaaccagaaagagtttggcgagttctgcttccataaaagcaatgacgacaaggagatcgacgagcctaagctcatctctttctatcagagtgtcctcaagaccgacttcgtgaagaacaccctcgctctccctcaatccgtcttcaacgaagtcgccattcagtccttcgagactaggcaggacttccagattgccttggagaaatgctgctacgcaaagaagcaaatcatcagtgagtctctcaagaaggagatcctcgagaactacaacacccagattttcaagatcacatccctcgacctccaaaggtcagagcagaagaacttgaagggacacaccaggatctggaatagattctggaccaagcagaacgaagaaataaattacaacctcagactcaatcccgagatcgcaatcgtctggaggaaggccaagaagaccaggatcgaaaagtacggagagcgaagcgtcctctacgagcccgagaagaggaacaggtatttgcacgaacagtacaccctctgtactaccgtcacagacaacgccctcaacaatgagatcaccttcgctttcgaagacaccaagaaaaagggcaccgaaatcgtgaaatacaacgaaaagatcaaccagaccctcaagaaggagttcaacaagaaccagttgtggttctacggcatcgacgcaggcgagattgagctcgctaccctcgccctcatgaacaaggacaaagagccccagctcttcaccgtgtatgagctcaagaagctcgactttttcaaacatggatacatatacaacaaggagagggaactcgttatcagggagaaaccctataaggccatccagaatctttcctacttccttaacgaagagctctacgaaaagaccttcagagacggaaagttcaacgaaacctacaacgagctctttaaggaaaaacacgtcagtgccattgacttgaccactgcaaaagttatcaacggtaagatcatcctcaacggcgacatgatcaccttcctcaacctcagaattctccacgcccagaggaagatatacgaggagctcatcgagaatccccacgccgaactcaaggagaaagattacaagctctacttcgaaatagaaggaaaggacaaggatatttacatctcaagattggatttcgagtacatcaagccctaccaagagatctccaactacctgttcgcctatttcgccagccaacaaatcaatgaggccagggaggaggagcagataaaccagaccaagagagctctcgctgggaatatgatcggtgtcatctattacctttaccagaagtatagagggatcatcagtatagaggacctcaagcagaccaaagtggagagcgacagaaataagttcgaagggaatatcgagaggcccctcgagtgggccctctacaggaaattccagcaggagggctatgttcccccaatctcagagctcatcaagctcagggaactcgagaagttccctctcaaggacgttaaacaacccaagtacgagaacatccagcaattcgggataatcaagttcgttagcccagaggagaccagcaccacttgccccaagtgcctcaggaggttcaaggactacgacaagaacaaacaggagggtttctgtaagtgtcagtgtggcttcgacaccaggaacgacctcaagggttttgaggggctcaacgaccccgacaaggttgccgcattcaacatagccaagaggggctttgaggacttgcagaagtataag

SEQ ID NO: 72 - DNA, 3192 bp, Artificial
  synthetic
atggagaagtacaagatcaccaagaccattagatttaagctcctcccagacaagatccaggacatcagcaggcaggttgccgtgctccagaactctacaaatgcagagaagaaaaataaccttctcaggctcgtgcaaaggggtcaggagctccctaagctcctcaacgagtacatcagatattcagataatcacaaactcaagtccaacgtgaccgtccacttcagatggctcagactctttaccaaggacctcttctataactggaagaaggacaacaccgagaagaagatcaagatttccgacgtcgtctatctctcacacgtgttcgaggcattcctcaaggagtgggagtccaccatcgagagagtgaacgccgactgcaacaagcccgaggagagcaagaccagggacgccgaaatcgcattgtctataaggaaactcggtatcaaacaccaattgcccttcatcaaagggttcgtcgacaactccaacgacaagaacagcgaggacaccaagagcaagctcaccgccctcctcagcgagtttgaggccgtcctcaagatctgcgagcaaaactatcttcccagccaatccagcgggattgctattgctaaggcctcattcaattattacaccattaacaagaagcagaaagattttgaggccgaaattgtcgccctcaagaagcagctccacgccaggtacggtaacaaaaagtacgaccaactcctcagggagctcaacctcattcccctcaaggagctccccctcaaggagctcccactcatcgagttctacagcgagattaagaagaggaagtccaccaaaaagagcgagttcctcgaggccgtttcaaacgggctcgtttttgacgatctcaaaagcaagttccccctttttcagaccgagtccaacaaatacgacgagtatctcaagttgagtaacaagatcacccaaaagtccactgccaagtccttgctctccaaggactcccctgaggcccagaaactccaaaccgagatcaccaaactcaaaaagaacaggggcgaatacttcaaaaaggccttcggcaaatacgtgcagctctgcgagctttacaaggagatcgccggaaagagggggaagctcaaggggcagatcaagggcatcgaaaacgagaggattgacagccagaggctccagtactgggccctcgtccttgaggataacctcaagcactccctcatcctcatccccaaggagaagacaaacgaactgtacaggaaggtctggggcgccaaagatgacggagccagcagctcttccagcagcacactctactacttcgaatccatgacttatagggccttgagaaaactctgcttcggtatcaacggtaacacctttctcccagagatacagaaagagttgccccagtacaaccagaaggagttcggggaattctgcttccacaagagcaacgacgacaaggagatcgacgagcccaaactcatctccttttaccagagcgttctcaagaccgacttcgtcaagaataccttggccctccctcagtctgtctttaatgaggttgccattcagagcttcgagactaggcaggacttccagatcgccctcgagaaatgctgctacgcaaagaaacagatcatttcagagtctctcaagaaggagatactcgagaactacaatactcagatattcaagatcacctccctcgatctccagagaagcgagcagaaaaatctcaagggtcacactaggatctggaataggttctggaccaagcagaacgaagagataaactacaacctcaggctcaacccagagatcgctatcgtttggaggaaggccaagaagaccaggatcgaaaagtacggggagaggagcgtgctctatgagcccgagaagaggaacaggtacttgcacgagcagtatactctctgcaccaccgtcaccgacaacgccctcaacaatgaaatcaccttcgccttcgaggatacaaagaagaaggggaccgagattgtgaaatataacgagaagatcaaccagaccctcaagaaggagtttaacaaaaaccagctctggttttacggcatagacgccggagaaatcgagctcgccaccctcgccctcatgaataaggacaaggagccccaactcttcaccgtgtatgagcttaagaagctcgacttcttcaagcacggctacatctacaacaaggaaagggagcttgtgatcagggagaaaccctacaaggcaatccagaacctcagctatttccttaacgaggaactctacgagaagacctttagggacgggaagttcaacgagacctacaacgagctcttcaaagaaaagcacgtgagcgccatcgaccttaccaccgcaaaagtgatcaacggtaagatcattttgaacggggacatgattaccttcctcaatctcagaatactccacgcccagaggaagatttacgaggaactcatcgagaacccccacgccgagctcaaggagaaggattacaagctctacttcgaaatcgaggggaaggataaggacatctacatcagtaggctcgattttgaatacattaagccctaccaggagatcagcaactaccttttcgcatacttcgcctcccagcagatcaacgaggccagggaggaagagcaaatcaaccaaaccaagagggccttggccgggaacatgatcggggtgatctactacctctaccaaaagtatagggggatcatcagcatcgaggacctcaagcagactaaggtcgagagtgatagaaacaagttcgagggcaacatcgagagaccactcgagtgggccctttacagaaagtttcaacaggaggggtacgttccccccatctccgagctcatcaagctcagggaactcgagaagttccccctcaaggacgtcaagcagcccaagtatgagaatatacagcagtttgggatcatcaaattcgtgagtcccgaggagacctccaccacctgtcctaaatgcctcaggaggttcaaggattacgacaagaacaagcaagaggggttctgcaaatgccagtgcggattcgataccaggaacgaccttaaggggttcgagggcctcaacgatcccgataaggttgccgcctttaacatcgccaagaggggctttgaggacctccagaaatacaag

SEQ ID NO: 73 - protein, 1228 aa, Unknown
  Lachnospiraceae bacterium
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 74 - DNA, 3684 bp, Artificial
  synthetic
atgtcaaagttggaaaagttcaccaattgctattcactttcgaaaactttgaggttcaaagctatacccgtcggtaagacgcaagaaaacattgataataagagactactggtcgaagatgaaaaacgtgcagaagattacaaaggtgtaaagaaacttctggacagatactacctcagcttcataaatgatgtgctccatagtattaaattgaagaacttgaataactatattagtcttttccgaaagaaaactagaacagaaaaggagaataaagaattggagaatctggagattaatctgcgcaaggaaattgcaaaagcattcaagggtaacgaagggtacaagtcactcttcaaaaaagacattatagagacgattctaccagaattccttgatgataaagacgagattgccctcgttaactcctttaacggttttactacagcatttactggcttcttcgataacagggaaaatatgttcagcgaagaagctaaatctacttcaatagcctttcgttgcataaatgagaacctgacccgctatataagcaacatggatatatttgagaaggttgacgctattttcgataagcatgaggttcaggagatcaaggagaagattctcaacagcgactacgacgtggaggattttttcgaaggcgagttctttaacttcgttttaacccaagagggaatagacgtttataatgcaatcattggaggattcgttaccgagagcggagaaaagataaaaggtcttaacgaatatatcaatctatacaaccagaagacaaagcagaaactcccaaaatttaaaccactttacaagcaagtcctctctgatcgtgaaagtctttctttttatggcgaaggttataccagtgacgaagaggtgttagaagtgtttagaaacacattgaataaaaactctgaaattttttccagcatcaagaaactggagaaactgtttaagaactttgatgagtactctagtgcgggcattttcgttaagaatggtcccgctatttcaaccatctcaaaagatatcttcggggagtggaacgtcatccgtgacaaatggaacgctgagtatgatgacattcatctgaagaagaaagcagttgtaactgagaagtatgaagacgataggagaaaatcatttaaaaaaatcggttctttctctttggaacagctccaagagtatgcggacgcggatctctccgtagttgagaagttaaaggagatcataattcaaaaagtcgacgaaatttataaggtgtatggctcaagtgaaaagctatttgacgcagacttcgtcctggagaaaagccttaaaaagaatgatgcagtcgtggctataatgaaggatctgttggactcagtgaagtctttcgagaactacattaaggctttttttggagaaggaaaggagacgaacagagatgagagcttttacggagacttcgtgcttgcctacgatatccttctgaaagttgatcatatttacgatgcaatacgtaattacgttacccaaaagccttatagcaaagacaagtttaagttatattttcaaaatccgcaatttatgggcggatgggacaaggataaggaaacagattatcgcgcaacaattttgagatatggttccaagtactatctggctatcatggataagaaatatgctaagtgcctgcagaaaatcgacaaagatgatgttaatgggaattatgaaaagattaactataaattattgcccggacctaacaaaatgttgcctaaggtttttttttcaaagaaatggatggcctactataatccttccgaggacatccaaaaaatttataagaacggtacatttaaaaaaggagatatgttcaacttaaatgattgtcacaagctaattgatttttttaaggactccatctctagatacccaaaatggagtaacgcctatgattttaacttcagcgaaactgaaaagtataaggatattgctggattttaccgggaagtggaggaacagggatacaaggtaagtttcgaaagtgcgtctaaaaaggaagtcgacaaattggttgaggaaggcaaactatacatgtttcagatctataacaaagacttcagcgataagtcacatggcaccccaaaccttcacactatgtactttaagctgctttttgacgaaaacaaccacggccaaatcagattgtcaggcggggcagagctttttatgcgtagggcttcactcaaaaaggaggagcttgtcgttcatcccgccaattctcctatagctaacaaaaatcccgataatcctaagaagaccacgacacttagctatgatgtttataaggacaagagattttctgaggatcaatatgagttgcatatccccattgctataaataaatgtcctaagaatatatttaaaattaatacagaagttagagtgctccttaaacacgatgataacccatacgtgatcggtattgacaggggagagagaaaccttctgtacatcgttgttgttgacggcaaaggcaatattgtggaacagtatagtctcaacgaaatcatcaacaactttaacggtatacgtattaagacagactatcatagccttttagataagaaagagaaggaacgtttcgaagcgagacaaaattggacaagcatcgagaatataaaggaactgaaagctgggtatatcagtcaggtcgttcataagatatgtgaattagttgaaaagtacgatgccgtaattgctttggaggacttaaactccgggttcaagaactctcgtgtcaaggtagagaaacaagtataccagaagtttgagaagatgcttattgataagcttaactacatggtagataagaagagcaatccttgtgctacaggtggggcacttaaaggttatcagataaccaacaagtttgaaagtttcaaatctatgagtacccaaaatgggttcattttttacattcccgcatggcttacctcgaagatcgacccaagtactggatttgtaaatttgttgaaaactaagtatacaagtattgcagattctaagaaatttatttcttcattcgaccgcattatgtatgttcctgaagaggatttattcgagtttgctctggactataagaacttctccaggacagatgctgattatattaagaaatggaaactttattcttacggaaaccggattagaattttcaggaacccaaagaaaaataacgtattcgattgggaggaggtgtgtttgacctctgcctacaaggagctatttaataaatacggcattaactatcaacaaggagacatcagggccttgctttgtgagcaaagcgataaagctttctattcgtcattcatggccttaatgagtctcatgctacagatgaggaattctataacaggtcgcacagatgttgattttttgatatcacccgtgaagaattcagacggaatattctacgactcacgtaactatgaggcccaagagaatgcaatacttccaaaaaacgctgacgctaatggcgcctataatatcgcaaggaaggtgctctgggccattggtcagtttaagaaagccgaagatgaaaaactggataaggtgaagattgcaatctcgaataaggagtggctcgagtatgctcaaaccagtgtaaagcac

SEQ ID NO: 75 - DNA, 3684 bp, Artificial
  synthetic
atgtccaagctcgagaagtttaccaattgctatagcctcagcaaaaccctcagattcaaggcaatccccgttggcaagacccaagaaaacatcgataacaagaggctcctcgtggaggacgagaagagggccgaggactacaagggggtgaagaagctcctcgacaggtactacctcagcttcatcaacgacgtgctccactccatcaagctcaagaatctcaataactacatctcccttttcaggaagaagaccaggaccgagaaggagaacaaggagctcgaaaacctcgaaatcaatctcagaaaggagatcgccaaagccttcaagggcaacgagggttacaagagcctcttcaagaaagacatcattgagaccatactccccgaattcctcgacgacaaggatgagatcgccctcgttaacagtttcaacggcttcaccaccgctttcaccggttttttcgacaacagggagaacatgtttagtgaggaggcaaagagtaccagcatcgccttcagatgtatcaatgagaacctcaccaggtacatcagcaacatggatatattcgagaaggtggacgccatcttcgacaagcatgaggtgcaggagataaaggagaaaatcctcaactccgactacgacgttgaggatttcttcgagggcgagttcttcaacttcgttctcacccaagagggcatagacgtctacaacgccatcataggcgggttcgtgaccgagtcaggggagaaaatcaaggggcttaacgagtacattaacctttacaatcagaaaacaaagcaaaagctccccaagttcaaacccctctacaagcaggtcctctccgacagggagtccctctccttctacggtgaggggtataccagcgatgaagaggtcctcgaggtgttcaggaacacccttaataagaacagcgagatcttcagcagcataaagaagctcgagaaattgttcaagaactttgacgagtactcctccgccggcatcttcgtcaagaacggtcccgccatttctactatcagcaaagacatattcggcgagtggaacgtcatcagggacaaatggaatgccgaatacgatgacatacacctcaagaagaaggctgtcgttaccgagaaatacgaagacgacagaaggaagagttttaaaaagatcggtagtttctcccttgagcagttgcaggaatatgctgatgctgaccttagcgtggtcgaaaaactcaaggagatcatcatacagaaggtcgacgagatttacaaggtctatggctccagtgagaagctcttcgacgccgacttcgttttggagaagagccttaagaagaacgacgccgttgttgccatcatgaaggacctcctcgatagcgttaagtccttcgaaaactatataaaggcctttttcggagagggtaaagagaccaacagggacgaaagcttctacggagacttcgtcctcgcctacgacatcctcctcaaagtcgaccacatctacgacgccatcaggaactacgttacccaaaagccctacagtaaggacaagttcaagttgtatttccagaacccccagttcatgggagggtgggacaaagataaagagaccgactacagagccaccatcctcaggtatggtagcaagtactacctcgccatcatggataagaagtacgctaagtgcctccagaagatcgacaaagatgacgttaacgggaactatgagaagatcaactataagctcctccccggtcccaacaagatgttgcccaaggtcttcttcagcaagaagtggatggcctattacaatcccagcgaggacatccagaagatctacaagaatgggaccttcaagaagggggacatgttcaacctcaatgactgccataagctcatcgactttttcaaggatagcatttcaaggtaccccaagtggtccaacgcctacgacttcaacttcagcgaaaccgagaagtacaaagacatcgccgggttctacagggaagtcgaggagcagggctacaaggtttctttcgagagtgcatctaagaaggaggttgacaagctcgtcgaggagggcaagctctatatgttccaaatatacaacaaggacttctccgacaagagccacggcacacccaatcttcataccatgtatttcaaactcctcttcgacgaaaacaaccacgggcagattaggctcagcggtggcgccgagctttttatgagaagggcatccctcaaaaaggaggagctcgtggtccatcccgccaactcccccatcgctaacaagaaccccgacaatccaaagaaaactaccaccctctcctacgacgtctacaaggacaagagattcagcgaggaccagtacgagctccacatccccatcgccatcaacaagtgtcccaagaacatcttcaaaatcaacaccgaggttagggttttgctcaagcacgacgataacccctacgtcattggaatcgacagaggggaaaggaacctcctctatattgttgtcgtggacggcaagggcaacattgtggaacagtactcccttaacgagatcatcaacaattttaacgggatcaggatcaagaccgattatcacagtctcctcgacaagaaagaaaaggagaggtttgaggccaggcagaattggacaagcattgaaaacataaaagaacttaaagccggctatatcagccaagtggtgcacaagatctgcgagttggtggagaagtacgacgccgtcatcgccctcgaggacctcaacagcggctttaagaactccagagtgaaggtggagaaacaggtttaccagaagttcgagaaaatgctcatagacaagctcaattacatggtcgacaagaagtccaacccctgcgccaccggtggggccctcaagggttatcagatcactaacaagttcgagtccttcaagtccatgagtacccagaacgggtttatcttctacattcccgcttggctcacatcgaagatagacccctccacaggtttcgttaacttgcttaaaactaaatacacctccatcgccgacagcaagaaatttatatcctccttcgataggatcatgtacgtccccgaggaggacctcttcgaattcgcccttgactataagaacttctctaggaccgacgcagactacatcaaaaagtggaagctctacagttacggaaataggatcaggatcttcaggaaccccaagaaaaacaacgtgttcgactgggaggaggtctgtctcaccagcgcatacaaggagttgttcaacaaatacggcatcaattaccagcagggggatataagagcactcctctgcgagcaatccgacaaagcattctacagctctttcatggccctcatgtcccttatgcttcagatgaggaactccatcaccggcaggaccgacgttgacttcctcatctctcccgtgaagaactctgacgggatcttctacgacagcagaaactatgaggcccaggagaatgccatactcccaaagaacgccgacgccaatggggcctataacattgctagaaaggtcctctgggccatcggacagttcaaaaaggctgaggacgagaagctcgacaaggtcaagatcgccatctccaataaggaatggctcgaatacgcccagaccagcgtcaagcac

SEQ ID NO: 76 - DNA, 3684 bp, Artificial
  synthetic
atgtccaagctcgaaaaattcacaaactgctactccttgagcaaaaccctcaggttcaaggccattcccgttgggaagacccaggaaaatatcgataacaagaggctcttggtggaggatgagaaaagggccgaggactacaagggtgtgaaaaagctcctcgacaggtactacctcagctttattaacgacgttctccactccatcaagcttaaaaacctcaataactacatcagcctctttagaaagaaaaccaggacagagaaggagaataaggagctcgagaacctcgagataaatctcagaaaggagatcgccaaggctttcaagggcaacgagggctataagagtttgttcaagaaggatatcatcgaaactatcctccccgaattcctcgacgataaagatgagatcgctcttgtcaactctttcaacggttttactactgcttttaccggtttcttcgataacagggagaacatgttcagcgaagaggctaaatccacctccatcgctttcaggtgcataaacgaaaatctcaccagatacatcagtaacatggatatctttgagaaggtggacgccatcttcgacaagcatgaggttcaagaaatcaaagaaaaaatccttaactccgactatgacgtggaggattttttcgagggcgagttcttcaacttcgttctcacccaggaggggatcgatgtctacaatgccatcatcggtggcttcgttactgagagcggcgagaaaatcaaagggctcaacgagtacatcaatctctataatcagaagaccaagcaaaagctccctaagttcaagcccctctacaaacaggtgctcagcgacagggagtccctctccttctacggagagggatacacctccgacgaagaggttctcgaggtgtttaggaacacactcaacaagaactccgagatcttctcctccataaagaagctcgagaaattgttcaagaatttcgacgagtattcctccgctggaatcttcgtcaagaatggccctgccatcagcaccattagcaaggacatctttggcgagtggaatgtgatcagagacaaatggaacgccgaatacgacgacatccacctcaaaaagaaagccgttgtgacagagaagtacgaagacgataggaggaagtccttcaagaagattggaagcttcagcttggagcagctccaagagtacgccgatgccgacctcagcgtcgtcgagaagctcaaggagatcataatccagaaggttgacgagatctacaaggtgtacgggagcagcgagaagctcttcgacgccgactttgttctcgagaagtccctcaaaaagaacgacgccgtggtcgcaatcatgaaggacttgctcgacagcgtcaagagtttcgagaattacatcaaggccttctttggcgagggaaaggagactaacagggacgagagcttctacggggatttcgtcctcgcctatgacatcttgttgaaggtggaccacatctacgacgccatcaggaattacgtcactcagaaaccctacagcaaagacaagttcaagctctacttccaaaacccacaattcatgggcggctgggataaggataaggagaccgactatagggccaccatactcaggtatgggtccaagtactaccttgccatcatggacaagaagtacgcaaagtgccttcaaaagatcgacaaagacgatgtgaatggaaactacgagaagatcaactacaagctcctccccgggcccaataaaatgctccctaaggtgtttttcagcaaaaagtggatggcttactacaacccctccgaggacatccagaagatctacaagaacggcactttcaagaagggcgacatgtttaaccttaacgactgtcacaagttgatcgacttcttcaaggattcaatcagtaggtaccccaagtggagcaacgcctacgacttcaacttcagcgagacagagaagtacaaggacattgctggtttctacagggaggtcgaagagcaaggttacaaggtatcattcgaaagcgccagcaagaaggaggtggacaaactcgtcgaggagggcaagctctatatgttccaaatctataacaaggatttctccgacaagagccacgggacccccaacctccacactatgtatttcaagctcctcttcgacgagaataatcacggtcagatcaggctcagtgggggtgccgagctctttatgagaagggcctccctcaagaaggaggagctcgtcgttcaccccgccaatagccctatcgccaacaagaaccccgacaaccccaaaaaaaccaccaccttgtcctacgacgtgtacaaagacaagaggttcagcgaggatcagtatgaattgcacatccccatcgcaatcaacaagtgccccaagaatatcttcaaaatcaacaccgaggtcagggtcctccttaaacatgacgataacccctatgtcatcgggatcgatagaggtgagaggaacctcctctatatcgttgtggtggacggcaaaggtaacattgttgagcagtacagcctcaacgagatcatcaacaactttaacggaatcaggatcaaaaccgactatcactccctccttgacaaaaaagagaaagagaggttcgaggccagacagaactggaccagcatcgaaaacatcaaggagcttaaggccgggtatattagccaagttgttcataagatttgcgagctcgtggagaagtacgacgccgtgatcgccttggaggacctcaattccggtttcaagaactccagggtcaaagtggagaaacaagtgtaccagaagtttgagaagatgctcatcgacaaactcaactacatggtcgacaaaaagagcaacccctgcgcaaccgggggagccttgaagggctaccagatcaccaataagttcgaatccttcaaaagcatgagcacccagaacggattcatattttacatcccagcctggctcaccagtaaaatcgatccctccaccgggttcgtgaatttgcttaaaaccaagtacaccagtatcgccgattccaagaaattcatcagctcattcgatagaatcatgtatgtccccgaggaggacctcttcgagttcgcccttgactacaagaacttctccagaaccgatgccgattatatcaagaagtggaagttgtatagctacgggaacaggattaggatcttcaggaaccccaagaagaacaacgtcttcgactgggaggaggtgtgcctcacctccgcctataaggagcttttcaacaaatacgggatcaactaccagcagggcgacatcagggccctcctttgcgagcaaagcgataaggccttctacagcagcttcatggctctcatgtccctcatgctccagatgaggaatagcatcaccggcagaaccgacgtcgacttcctcatttcccccgtgaagaatagcgacggcatcttctacgactccaggaactacgaggcccaggagaacgccatcctccccaagaacgccgacgccaacggtgcttacaacatcgctaggaaggtgctctgggccataggtcaattcaagaaagccgaggacgaaaagctcgacaaggtgaaaatcgccatctccaacaaagagtggcttgagtacgcccagacttccgtcaaacac

SEQ ID NO: 77 - DNA, 3684 bp, Artificial
  synthetic
atgtccaaactcgagaagttcaccaattgttactccctcagcaagaccttgaggttcaaggccatccctgtgggtaaaacccaggaaaacatcgacaacaagagactcctcgtcgaggacgagaagagagccgaggactataagggcgtcaaaaagctcttggacaggtactatctctccttcatcaacgacgtgctccattccattaaacttaagaaccttaacaactatatctccctcttcagaaaaaagaccagaaccgagaaagagaacaaggagctcgaaaaccttgagataaacctcagaaaggagatcgccaaggccttcaaagggaacgaggggtacaagagcctctttaaaaaggatattatcgagaccattctccccgaatttctcgatgacaaggacgaaatcgccctcgtgaactcctttaacgggttcaccacagcattcaccggtttcttcgacaacagggagaatatgttctctgaggaggcaaagtccaccagcatagcctttagatgcatcaacgagaacctcaccaggtacatctccaacatggacatcttcgagaaggtggatgctattttcgataagcacgaggtccaggagatcaaggagaagatcctcaatagcgactacgatgttgaggattttttcgagggtgagttctttaacttcgtgctcacccaggagggtatcgacgtctataacgcaatcataggtgggttcgtgacagaaagcggtgaaaagatcaaaggcctcaatgagtatattaacctctacaatcagaaaaccaagcaaaagctcccaaagttcaagcccctctacaagcaagtgctcagcgacagggagtccctcagcttctacggagagggctacaccagtgacgaggaggttcttgaggtgttcaggaataccctcaacaagaacagcgaaattttctcttccattaagaagctcgagaagctctttaagaacttcgacgagtacagctccgccggcatcttcgtgaagaacgggcctgccatatctaccatatccaaggacatcttcggcgagtggaacgttatcagagacaagtggaacgccgagtacgatgacatccacctcaagaagaaggccgtcgtcaccgagaagtatgaagatgacaggagaaagagtttcaagaaaatcgggtcattctcactcgagcagctccaggagtatgcagacgccgacctcagcgtcgtcgagaagctcaaagagatcataatccagaaggtcgacgagatttacaaagtctacgggtcctccgagaagcttttcgatgccgacttcgtgcttgagaaaagtctcaaaaaaaacgacgccgtggtggccatcatgaaggacctccttgacagcgtcaagtccttcgagaactatatcaaggcattctttggcgaaggtaaagagacaaacagagacgagagtttctacggtgatttcgttctcgcctacgatatactcctcaaggtcgatcacatctacgacgccatcaggaactacgtcacccagaaaccctacagcaaagacaagtttaagctctacttccagaacccccagttcatgggcggctgggacaaagacaaggagaccgattatagggctaccatcctcagatacggttccaaatactacctcgccatcatggacaagaaatatgccaagtgcctccagaagatagataaagatgacgttaatggaaactacgagaagatcaactacaagctcctccccggccccaacaagatgctccccaaagtttttttcagcaaaaagtggatggcctactataaccccagcgaggacatccagaaaatatacaagaacgggaccttcaagaaaggtgacatgtttaacctaaacgactgccacaagcttatcgattttttcaaggacagcatcagcaggtaccccaagtggtccaacgcctatgacttcaacttcagcgagacagagaaatacaaggacattgccgggttttatagggaggtggaagagcagggatacaaagtgtctttcgaatccgcctcaaagaaggaagtcgacaagctcgttgaagaaggcaagctttatatgttccagatctataataaggacttcagtgacaagtcccacggcaccccaaatcttcataccatgtacttcaagttgcttttcgatgagaataatcacgggcagatcagactctctgggggggccgagctcttcatgagaagggcctccctcaaaaaggaggagctcgtggttcaccccgccaacagccccatcgcaaataagaaccccgacaaccccaagaagaccaccaccctctcctacgacgtttacaaggataagaggttctccgaagaccagtatgagctccatatcccaatcgctatcaacaagtgccccaagaacatcttcaagatcaacactgaggttagagtgctcctcaagcacgacgacaacccttatgtgatagggatcgacaggggcgagaggaacctcttgtacatcgtggttgttgacgggaaaggtaacatcgtcgagcaatattccctcaatgaaatcattaataattttaacggcatcaggataaaaacagactaccacagcctcctcgacaagaaggaaaaggagaggttcgaggccaggcagaactggacctctatcgagaacatcaaggagctcaaggccggctatatctctcaggttgtgcacaaaatctgcgagcttgtcgaaaagtacgacgccgttatcgccctcgaggaccttaacagcggattcaagaactccagggtgaaggtggagaagcaggtctaccagaagttcgagaagatgctcattgacaagctcaactatatggtcgacaagaaatccaatccttgcgccacaggcggagccctcaaggggtatcagatcaccaacaagttcgaaagctttaagagcatgtcaacccaaaacgggtttatattttatatcccagcctggctcaccagcaagatcgacccatccaccggattcgttaacctcctcaaaaccaagtacaccagcatcgccgattccaagaaattcatctcctcattcgatagaatcatgtatgtgccagaggaagacctcttcgagtttgctctcgactacaagaacttctctaggaccgacgccgactacatcaagaagtggaagttgtacagctacggcaacaggatcaggatcttcaggaaccccaagaagaataacgtctttgattgggaggaggtgtgtctcacctccgcctacaaggagctctttaataagtatggcatcaactaccagcagggggatatcagggccctcctctgcgagcagagcgataaggccttctacagctcctttatggccctcatgagcctcatgctccagatgaggaatagcatcaccggaaggaccgacgttgacttcctcatctctcccgttaagaactccgacggcatcttttacgactccaggaactacgaggcccaagagaacgccattctccccaagaacgccgatgccaatggcgcctacaacatcgccaggaaagtgctctgggccatcggccagttcaaaaaggctgaggacgagaagctcgacaaagttaagatcgctataagcaacaaggagtggcttgagtatgcccagacctctgttaagcac

SEQ ID NO: 78 - DNA, 3684 bp, Artificial
  synthetic
atgtccaagctcgaaaaatttacaaattgctacagcctcagcaagaccctcaggtttaaggctatccccgttggcaagacccaggaaaacatcgacaacaagagactccttgttgaggacgagaaaagagctgaagattacaagggggtgaaaaagcttctcgacaggtactacttgtcatttatcaacgacgtcctccacagcatcaagctcaagaatttgaacaattatattagcctcttcaggaagaagaccaggaccgagaaagagaacaaggagctcgagaaccttgaaattaaccttaggaaagagatagccaaggctttcaaggggaacgaggggtacaagtccctcttcaagaaggacatcatcgaaaccatccttcccgagttcttggacgataaggacgagattgcccttgtcaactcattcaacgggttcaccaccgcctttactgggttcttcgacaacagggaaaatatgttttccgaagaagccaagagcacctccatagctttcaggtgcatcaacgagaaccttaccaggtatatcagtaacatggacatcttcgaaaaggtcgatgctatcttcgacaagcacgaagtccaggaaattaaggagaagattcttaactccgattacgacgtggaggacttcttcgagggagagttcttcaacttcgtcctcactcaggaggggatcgacgtgtacaacgccatcatcgggggctttgtgacagagtctggggagaagattaagggcctcaacgaatacatcaacctctataatcaaaagaccaagcaaaagttgcccaagttcaaacctctctacaagcaggtgctttcagacagagagagcctcagcttctacggcgagggttacacctccgatgaggaggtgctcgaagtcttcaggaacactctcaacaagaatagcgagatattctccagtatcaaaaagctcgagaagctcttcaagaactttgacgagtactctagcgccggcatattcgtcaaaaacggccccgctatctccaccatcagcaaggacatctttggtgagtggaacgtgatccgggacaaatggaacgccgaatacgacgatatccacctcaagaaaaaggccgtcgtcaccgaaaagtatgaggacgacaggaggaagtcctttaagaagattggttccttctccttggagcagcttcaagagtacgccgacgccgacctcagcgtcgtcgaaaagcttaaggagatcatcatacagaaagtggacgaaatatacaaggtttacgggtcctctgagaagctctttgatgcagacttcgtccttgagaagtccctcaagaagaacgacgccgttgtcgccatcatgaaggacctcctcgacagcgtgaaatcatttgaaaactacataaaggccttttttggggagggcaaggagaccaacagagacgaatccttctacggcgacttcgtgctcgcctacgatatcctccttaaagtcgatcacatttatgacgcaatcagaaactatgtcacccaaaaaccctacagcaaggacaaattcaagttgtactttcaaaacccccagttcatgggagggtgggacaaggataaggagaccgactatagggccaccatcttgagatacgggtccaagtattaccttgccatcatggacaagaaatacgccaaatgtcttcagaaaatcgacaaggacgacgtgaacgggaactacgaaaaaatcaactacaagctcctccccggccccaacaagatgctccccaaggtctttttcagtaagaagtggatggcctattacaacccctccgaggacatccagaaaatatacaagaacggtacctttaagaagggcgatatgttcaatttgaacgactgccacaagctcattgatttcttcaaggattccatcagcaggtatcccaaatggtcaaacgcctacgatttcaatttctccgagaccgagaaatacaaggacatcgccgggttctatagggaggtcgaggagcaggggtataaggtcagttttgagtcagccagcaagaaagaggtggacaagttggttgaagagggtaagctttacatgttccaaatctacaacaaggacttcagcgacaagtcccacgggacccccaacctccacaccatgtacttcaagctcctcttcgacgaaaacaatcacggtcagatcaggctctccggaggcgccgagctcttcatgaggagggcctcccttaagaaggaagaactcgtggttcaccccgccaacagccccatcgccaacaagaaccccgataaccccaaaaaaaccacaacactttcctatgacgtttacaaggacaaaaggttctctgaggaccagtacgagctccacatccctatcgccatcaataagtgtcccaagaatatctttaagatcaacaccgaggtgagggtgctcctcaagcacgacgacaatccctacgtgatcggcatcgacaggggagagaggaacctcctctatatcgtcgtcgtcgacggcaaggggaatatcgttgaacaatatagcctcaacgaaatcatcaacaactttaacggcatcaggatcaagaccgactaccacagcctcctcgataagaaggaaaaggagagattcgaggctaggcaaaattggacctccatcgagaacatcaaggagctcaaagccggttacatcagccaagtggtgcataagatttgcgaacttgtggagaagtatgacgccgtgatcgcccttgaagacctcaacagcgggttcaaaaactccagggtcaaggtcgagaagcaggtctaccaaaagttcgagaagatgctcatcgacaagctcaactatatggtggacaagaagagcaatccctgcgccacagggggggccctcaaggggtaccagatcaccaacaagtttgaaagcttcaaaagcatgtccacccagaacggctttatcttctacatccctgcctggctcacctccaagatcgaccccagcacaggcttcgttaacctcctcaagactaagtatacctccatcgccgacagcaagaagtttatcagctcattcgacaggatcatgtacgtcccagaggaggacctcttcgagttcgccctcgactacaagaattttagcaggaccgacgctgactatataaagaagtggaaactctacagttacggcaataggatcaggatcttcaggaaccccaagaaaaacaacgttttcgactgggaggaggtctgcctcaccagcgcctacaaggaactctttaacaagtacggcataaactaccagcagggcgacatcagggccctcttgtgcgaacagtccgacaaggccttctactcctccttcatggccctcatgtccctcatgcttcaaatgagaaattccatcaccggtaggaccgatgtcgacttcctcatcagccctgttaaaaacagtgacgggatcttctacgactccaggaactacgaggcacaggaaaacgccatccttcccaagaacgcagacgctaacggtgcctacaatatcgctaggaaagtcctctgggctatcggacagttcaagaaggccgaggacgaaaaactcgataaggtcaaaatagccatctctaacaaggaatggctcgaatacgcccagactagtgtgaagcac

SEQ ID NO: 79 - DNA, 3684 bp, Artificial
  synthetic
atgagtaagcttgagaagttcaccaactgttacagcctttcaaagaccctcaggttcaaagccatccccgttggcaaaacccaggaaaacatcgacaacaaaaggcttctcgttgaggacgaaaagagggccgaggattataagggcgtcaagaagttgctcgacaggtactacttgtctttcatcaacgacgttctccacagcatcaagctcaagaatctcaacaactatatctccctcttcaggaaaaaaactagaaccgagaaggagaacaaggagctcgagaaccttgagatcaacttgagaaaggaaatagctaaggcattcaagggaaacgaagggtacaaaagcctttttaagaaggatatcatcgagaccattctccccgagttcctcgacgacaaggacgagatcgccctcgttaattccttcaacgggttcaccactgcctttacagggttcttcgacaacagggagaacatgttctctgaggaggccaagtccacatctatcgcctttaggtgcattaacgagaacctcaccaggtacatttccaatatggacatcttcgagaaggtggacgccatcttcgacaagcacgaggtgcaagagatcaaggagaagatactcaactccgactacgatgtggaggatttcttcgagggggagttttttaacttcgttctcacccaagaggggattgatgtctacaatgccatcataggggggttcgtcacagagagcggtgagaagatcaagggtctcaacgagtatatcaacctttataaccaaaagacaaagcaaaaactccccaaattcaagcccttgtacaagcaggtcctctccgatagggagagtctctccttctacggggaggggtacacatccgacgaggaagtccttgaagtcttcaggaacactttgaacaagaactccgaaatcttcagctccattaaaaagctcgagaagctcttcaagaacttcgacgagtattctagcgccggtatcttcgttaagaacgggcctgccatcagcaccatctccaaggacatatttggggagtggaatgttattagggataagtggaatgccgagtatgacgacatccatctcaagaaaaaggccgtggttaccgaaaagtatgaagacgacaggaggaagagcttcaagaaaatcggatccttctccctcgagcagctccaggagtatgccgacgccgacctcagcgtggttgaaaagctcaaggagatcatcatccagaaggtcgacgaaatctacaaggtctacggctcctcagagaagcttttcgatgccgactttgtcctcgaaaagtcacttaagaagaatgacgccgtcgttgccatcatgaaagatctcctcgactcagtcaagagcttcgagaattacatcaaagcatttttcggcgagggaaaggagaccaacagggacgagtccttctacggcgattttgtcctcgcctacgatatcctcctcaaggtggaccacatctacgatgctataaggaactacgtcactcagaagccatactcaaaggacaagttcaagctttattttcagaacccccaatttatgggcgggtgggacaaggataaggagaccgattacagggccaccatcctcagatatgggagcaagtattacttggccatcatggacaagaaatatgcaaagtgtctccagaagatcgacaaggacgacgtcaacggtaactacgaaaaaatcaactataagctcttgccaggtccaaacaagatgctccccaaggtttttttctcaaagaaatggatggcctactacaacccctccgaggacatccagaagatctacaagaatggcacctttaaaaagggtgacatgtttaaccttaacgattgccataaactcatcgacttcttcaaggactccatcagcaggtaccccaagtggagcaacgcctacgacttcaatttctcagagaccgaaaaatataaggacatcgctggcttctacagagaagtcgaggagcaggggtataaggtgagcttcgaaagtgcttccaagaaggaggtggacaaactcgtggaggaaggtaagctctacatgttccagatctataacaaggactttagcgacaagagccacggcaccccaaatctccacacaatgtacttcaagttgctcttcgacgaaaataaccacgggcaaatcaggctcagcgggggggccgagctcttcatgaggagggccagcctcaagaaggaggaactcgtcgtgcaccccgccaatagccccattgccaacaagaaccccgacaaccccaagaagaccaccaccctctcttatgacgtctacaaggacaaaaggttctctgaggaccaatacgagttgcacattccaatcgccatcaacaagtgtcccaagaacatcttcaagatcaacacagaggtgagggtcctcctcaagcacgacgacaacccctacgtcatcggaatcgacagaggagagaggaatctcctctacatcgtggtggtcgacggtaaggggaacatagtcgagcagtactcactcaacgaaatcattaacaacttcaacggcatcagaatcaaaaccgattaccacagcctcctcgacaagaaggagaaggagaggttcgaagccaggcagaattggacaagcatcgagaacatcaaggaactcaaagccggttatattagccaggtcgtgcataagatctgcgagctcgttgagaagtacgacgccgtcatcgccctcgaggatttgaactccgggttcaagaactcaagggtgaaggtggagaaacaggtgtaccagaagttcgagaagatgctcatcgataagctcaactatatggtggacaagaagagcaatccatgcgccaccggcggagccctcaagggctaccagataaccaataagtttgaatccttcaagagcatgagcacccaaaatggttttatcttttacattcccgcctggctcaccagcaagatcgatcccagcaccgggttcgtcaatctcctcaagaccaagtacacctctatcgccgatagtaagaaattcatcagctccttcgataggatcatgtacgtccccgaggaagacctctttgagttcgcactcgactacaaaaacttctcaaggacagatgccgactacatcaagaagtggaagctttattcatacgggaacaggatcaggatcttcagaaaccccaagaagaacaacgtgttcgactgggaagaagtctgcctcacttccgcctacaaggaactcttcaacaaatacggcatcaactatcagcaaggcgatatcagggccttgctctgcgagcaaagcgataaggccttttacagcagcttcatggctctcatgtccctcatgctccagatgaggaactccatcactggcaggaccgatgtcgactttctcatctcccccgtgaagaacagcgacggcatcttttatgatagcaggaactacgaggcccaagagaatgccatcttgcccaagaacgccgacgctaatggtgcctataacatagccaggaaggtgttgtgggccatcggacagtttaagaaggccgaggatgagaaattggataaggtgaagatagccatcagcaacaaggagtggcttgagtacgcacagaccagtgttaagcat

SEQ ID NO: 80 - DNA, 3684 bp, Artificial
  synthetic
atgagcaagctcgagaagtttaccaactgctacagcctctccaaaaccctcagattcaaggccatacccgttggaaagacacaggagaacatcgacaacaagagactcctcgtcgaggacgagaagagggctgaagactacaagggagtcaaaaagcttctcgacaggtattacctcagcttcataaatgacgtcctccacagcatcaagctcaagaatctcaacaattacatctcactctttaggaagaagaccaggactgagaaagagaacaaggagctcgagaacttggagatcaacctcagaaaagagatcgccaaggccttcaagggcaacgaaggctacaagtccctctttaagaaggacatcatcgagaccatcctccccgagttcttggacgacaaggacgagatcgcactcgtgaattccttcaacggctttaccactgcctttaccggtttcttcgacaatagggaaaacatgttcagcgaggaagccaagtcaacaagtatcgccttcaggtgcatcaacgagaatctcactaggtatattagcaatatggacatcttcgagaaggtcgatgccatcttcgataaacacgaggtccaagagatcaaggagaagattctcaactccgattacgatgtggaggacttcttcgagggggagtttttcaatttcgtcctcacccaggaggggatcgatgtgtacaacgccatcatcgggggcttcgtcaccgagtccggagagaagatcaagggcctcaacgagtacatcaacctctataaccagaagaccaaacaaaagctccccaagtttaagccactctacaagcaggttctctccgacagggagagtttgagcttctacggggaaggctacacctccgacgaggaagttctcgaggtctttaggaacaccttgaacaaaaattccgagatcttcagcagcatcaagaagttggagaagctctttaagaacttcgacgagtactcatccgcaggaatattcgttaagaatggccctgccatctccactatctccaaggatatcttcggggagtggaacgttatcagggacaagtggaacgccgagtacgacgacatacacctcaagaagaaggcagtggtgaccgaaaagtacgaggacgacaggaggaagtcatttaagaagatcgggtcatttagcctcgagcaactccaggagtacgccgacgccgatctctccgtcgttgagaagctcaaggagattatcattcaaaaggtcgacgagatctacaaggtttatgggagttccgaaaagctcttcgacgccgactttgtgctcgagaagtccttgaagaagaacgacgccgtcgtcgccattatgaaggacctccttgatagcgtcaagtccttcgagaattacataaaagccttctttggggagggcaaggagacaaacagggacgagagcttctacggggattttgttcttgcttacgacatcttgctcaaggtcgaccacatctacgacgccatcaggaactacgtgacccaaaaaccttatagcaaggacaagtttaagctctatttccagaacccccaattcatgggcggatgggacaaagacaaggagaccgattacagggccaccatacttaggtacggctccaagtattatttggccatcatggacaagaagtacgccaaatgcttgcaaaagatcgacaaggacgacgtgaacggcaactatgagaagatcaactacaagttgctccccgggcctaacaagatgctccccaaggttttcttctccaaaaagtggatggcctactacaaccccagtgaggacatccaaaagatatacaagaacggtaccttcaagaaaggcgatatgttcaacctcaatgactgtcacaagctcatcgattttttcaaggacagcatctcaagataccccaagtggagcaacgcttacgacttcaacttctctgagacagaaaagtataaggacatcgccggcttctacagggaagttgaggagcaaggctacaaggtctcctttgagtccgccagcaagaaagaggtggataaactcgtcgaggaggggaaactttacatgttccagatctataataaggacttctcagacaagagccatggcacccctaacctccacaccatgtacttcaaactcctctttgacgagaacaaccatggccagatcaggttgagcggtggagccgagctcttcatgaggagggccagcctcaagaaggaggaactcgtggtgcaccccgccaactcccccatagccaataagaaccccgacaatcccaagaagaccaccaccctctcttacgacgtctacaaggacaaaaggttttctgaggaccagtacgagctccatatccctatcgccatcaacaagtgccccaagaatatcttcaaaatcaacaccgaggtgagagtgcttctcaagcacgatgacaacccctatgtgataggcatcgataggggcgagaggaacctcttgtatatagtcgtcgtcgacggcaaggggaatatcgttgaacagtatagcctcaacgagatcatcaataatttcaatggcatcaggatcaagacagactaccattcccttctcgacaagaaggagaaagaaaggttcgaagccaggcagaattggacctccattgagaacatcaaggaacttaaggccggttacatctcccaagtcgtgcacaaaatctgcgaactcgtcgagaagtacgatgccgttatcgcattggaggacctcaactcagggtttaagaactccagggtgaaagtcgagaagcaggtgtaccagaagttcgagaaaatgttgatcgacaagctcaactacatggtggacaaaaagagcaacccctgcgccaccggtggtgcactcaaggggtaccaaatcacaaacaagtttgaatccttcaagagcatgtccacccagaacgggttcatcttctacatccccgcttggctcacttccaagatagacccctcaaccgggtttgtgaacctcctcaaaaccaagtacacctccatagccgactccaagaagttcatttcaagcttcgacagaattatgtacgtgcctgaggaggatctcttcgagtttgccctcgactacaagaacttcagtaggaccgacgccgattacatcaagaagtggaaactctacagctacggcaacagaatcagaatcttcagaaatcctaagaaaaacaacgttttcgactgggaggaggtctgcctcacctccgcatacaaggagctcttcaacaagtacggaatcaattaccagcagggggacatcagggcactcctctgcgagcagtccgacaaggctttctacagctccttcatggccctcatgtccctcatgctccagatgaggaattcgatcaccgggaggaccgacgtcgatttcctcatctcccccgtcaagaacagcgacgggatcttctacgacagcaggaattacgaggcccaggagaatgccatcctccccaaaaacgccgatgccaacggcgcctacaatatagccaggaaggttctctgggcaataggccaattcaagaaggccgaggacgaaaaactcgacaaagtgaagatcgccatatcaaataaggagtggctcgagtacgcccagaccagcgttaagcac

SEQ ID NO: 81 - DNA, 3684 bp, Artificial
  synthetic
atgtctaagctcgagaagttcacaaactgctactcactcagcaaaaccttgaggttcaaagccatcccagtgggcaagacccaggaaaacatcgataacaagaggctccttgtcgaggatgaaaaaagggccgaggactacaagggcgtcaagaagctcctcgacaggtactaccttagtttcatcaacgacgtcctccacagtatcaagctcaaaaaccttaacaactacatctcccttttcagaaaaaagaccaggaccgaaaaggagaacaaggagctcgaaaatttggaaatcaatctcaggaaggaaatcgccaaggccttcaagggaaacgaggggtacaagtccctcttcaagaaagacatcatagagaccattctccccgagtttcttgatgacaaagacgagatcgctctcgtgaactctttcaatggcttcaccactgccttcaccggcttctttgacaacagagagaacatgttctccgaagaggccaagagcacaagcattgccttcagatgtatcaacgagaacctcacaaggtacatcagtaacatggacatttttgagaaggtcgatgccatcttcgataaacacgaagttcaagagatcaaggagaagattctcaacagcgactacgacgtcgaggattttttcgaaggtgagttctttaacttcgtcctcactcaggagggcatcgacgtctataacgccatcatcggtggcttcgtcaccgagtctggagaaaagatcaaagggcttaacgagtatatcaatctttacaaccagaagaccaagcagaaactccccaaattcaagcccttgtacaagcaagtgctcagcgacagggagagcctttccttctacggcgaaggctataccagcgacgaggaggtgctcgaggtgtttagaaacaccctcaacaagaactccgagatattctcaagcatcaagaagctcgagaagctctttaagaacttcgatgagtacagcagtgccggtatcttcgttaaaaacggacccgccatctccaccatttctaaggacatcttcggagagtggaacgtgatcagggataagtggaacgccgaatacgatgacatccacttgaagaagaaggccgtcgttaccgagaagtacgaggacgacaggaggaaaagcttcaagaagatcggcagcttctcactcgagcaactccaggaatacgccgatgccgacctcagcgttgtggagaagctcaaagagataatcatccagaaggtcgacgaaatttataaggtgtacgggtcatccgagaaactctttgacgccgacttcgtcctcgagaagtctctcaagaagaacgacgcagtcgttgccatcatgaaggatctccttgactccgtcaagtcctttgagaattacatcaaggctttctttggagagggcaaggagaccaacagggacgagtccttttacggcgacttcgtccttgcctacgacattctcctcaaagtcgatcacatctacgacgcaatcaggaactacgtcacccagaaaccttactccaaggacaagttcaaactctatttccagaacccccagttcatgggtggctgggataaagacaaggagaccgactatagggccaccatcctcaggtacggttccaaatactaccttgccatcatggacaagaagtatgccaagtgcctccagaaaatcgacaaggacgacgttaatggtaattacgagaagatcaattacaagctcttgcccggtcccaataagatgcttcccaaggtgtttttcagcaagaaatggatggcttactataatcccagtgaggatatccaaaagatctacaagaacgggaccttcaaaaaaggagacatgttcaacctcaatgattgccataaactcatcgatttcttcaaggacagcataagcaggtatcccaagtggtccaacgcctacgacttcaacttcagcgaaacagagaagtacaaggacattgccggattctatagagaggtggaagaacagggctacaaggtgagcttcgagtccgcctccaagaaggaggtggacaagctcgttgaggagggcaagctttacatgttccagatctacaacaaggatttttctgacaaaagccacggaactcccaacctccacaccatgtacttcaagctcctcttcgatgagaacaaccacggtcagatcaggcttagcgggggcgccgagttgtttatgagaagggccagcctcaaaaaggaggagctcgtggtgcaccccgccaactcacccatcgccaacaaaaaccccgacaaccccaagaagaccaccaccctctcttacgacgtttacaaagacaagaggttcagcgaggatcaatatgagctccatatcccaatcgccataaataagtgcccaaagaacatctttaaaatcaacaccgaagttagggtgctcctcaagcacgatgacaacccctacgtcatcggcattgacaggggcgagagaaatctcttgtacatagttgttgtggatggcaagggcaatatcgttgagcagtattccctcaacgagatcataaacaacttcaacggcatcaggatcaagacagactaccactccctccttgacaagaaggagaaagagaggtttgaggccaggcaaaactggacttccattgagaacatcaaggagctcaaggccggttacatctcccaagtggtgcacaaaatctgcgagctcgtggagaagtacgacgccgtcatagccctcgaggacctcaactctggattcaagaacagcagagttaaggtggaaaagcaagtctatcagaagtttgagaaaatgctcatcgacaaactcaactacatggttgacaaaaagagcaacccctgcgcaaccgggggggccttgaagggttaccagatcaccaacaagttcgagtctttcaaaagcatgagcacccagaatgggttcattttctacatccccgcctggctcaccagtaagatcgacccctccaccggctttgtgaacttgctcaagacaaaatacaccagcatcgccgacagtaagaaattcatatcaagcttcgataggatcatgtacgtgcccgaggaagacctcttcgagttcgccctcgactacaaaaacttcagcagaaccgatgccgactacataaagaagtggaaactctattcatacggaaatagaataaggatcttcaggaaccccaagaaaaacaacgttttcgactgggaggaggtctgcctcaccagcgcttacaaagaactctttaacaaatatgggatcaactatcagcagggggacataagggccttgctttgcgagcagtcagataaggccttctactccagcttcatggccctcatgagcctcatgctccagatgagaaactccatcaccgggagaaccgatgtggatttccttatctcccccgtgaagaacagtgatggaatcttctatgacagcagaaactacgaggcacaagagaacgccatcctcccaaagaacgctgacgccaacggggcctataacattgccaggaaggttctctgggccatcgggcagtttaagaaagccgaagatgagaagctcgacaaggtcaagatcgccatctccaataaagaatggctcgagtacgctcagacctccgtgaagcac

SEQ ID NO: 82 - DNA, 3684 bp, Artificial
  synthetic
atgtctaagctcgagaagttcaccaattgctattcccttagtaagaccttgaggttcaaggctatcccagtcggcaagacccaggagaacatagataacaaaaggctcctcgtggaggacgagaagagggccgaggactacaagggagtcaagaagcttctcgacaggtactatctctcctttatcaacgatgtgctccactccatcaagctcaagaacctcaataactacatctctctctttaggaagaagaccaggacagagaaggagaacaaggaactcgagaacctcgagataaaccttaggaaggagatcgccaaagcattcaaagggaacgaaggctacaagagcctctttaagaaagacatcattgaaacaatcctccccgagttcctcgacgataaggatgagatcgctttggtgaactcctttaacggttttaccaccgccttcaccggcttcttcgacaacagggagaatatgttctccgaggaagccaaaagcacctctatcgcattcagatgtatcaacgaaaacctcaccaggtacatcagcaacatggacatatttgagaaggttgacgccatctttgataagcatgaagtgcaagaaataaaggagaagatcctcaatagcgactacgatgtcgaagatttctttgaaggcgagttcttcaacttcgtgctcacccaagagggcatcgatgtttacaacgccataatcggaggattcgtcaccgaatccggggagaagattaaggggctcaacgagtacatcaacctctacaaccagaaaaccaagcagaaactccccaagttcaagcccctctacaagcaggtgctcagcgacagagagtccttgagcttctacggggaaggctacaccagtgacgaagaggtacttgaagttttcaggaacaccctcaacaagaatagcgagatcttttccagcatcaaaaagctcgagaaactcttcaagaacttcgatgagtactcctccgccggtatcttcgtgaagaacggaccagccatcagcaccatcagcaaagacatcttcggagagtggaatgtgatcagggacaagtggaacgccgagtacgacgacatccatctcaagaaaaaggccgtggtcaccgagaagtacgaggacgacaggaggaagagcttcaagaagatcgggagttttagcctcgagcagcttcaggagtacgccgacgctgacctttccgtcgtggaaaaacttaaggagataataatccagaaggttgatgagatctacaaagtttacgggtcctcagagaagctctttgacgccgacttcgtgcttgagaagtccctcaagaagaacgacgctgtggtggccatcatgaaggacctcctcgacagtgttaagtccttcgagaactacatcaaggccttcttcggcgagggcaaggagaccaacagagacgagtccttctatggtgacttcgtgctcgcatacgacatccttctcaaagtggaccatatctacgacgccatcaggaactacgttacccagaagccctactccaaggacaaatttaagctttatttccagaatccccaattcatgggaggatgggacaaggacaaggagaccgactacagggcaaccattctcaggtacgggagcaagtactatctcgccatcatggataagaagtacgccaaatgtctccagaagatcgacaaggacgatgttaacggcaattacgaaaagatcaattacaagttgctccctgggcccaataagatgctccccaaagtgttcttctccaagaagtggatggcatactacaacccttccgaggacatccagaagatttacaagaatggcaccttcaaaaagggggacatgttcaatctcaatgattgccataaactcattgacttttttaaagacagcatctccagataccccaaatggagcaacgcctacgacttcaacttctccgagaccgaaaagtacaaggacatcgccgggttctacagggaagttgaggagcagggctacaaggtctccttcgagtctgcctccaagaaggaagttgacaagttggtggaggaagggaaactctacatgttccagatctacaataaggacttctccgacaagtcccacggcacccccaaccttcacaccatgtacttcaagcttctctttgatgagaacaaccatggtcaaatcagattgagcggcggagccgagctcttcatgaggagagctagcctcaagaaagaggagctcgtcgttcaccccgccaactcccccatcgccaacaagaaccccgacaatcccaagaagaccaccaccctctcatatgacgtgtacaaggacaagaggttcagcgaagaccagtacgaactccacatccccatagccatcaataagtgtcccaagaacatcttcaagataaacaccgaggtgagggtcctcctcaaacacgatgataatccttacgtcatcggcatcgacaggggggagaggaaccttctctacatcgttgtcgtcgacgggaaggggaatatcgttgagcagtattccctcaatgagataataaataacttcaacggcattaggataaaaaccgactaccacagcctcctcgacaagaaagaaaaggagaggttcgaggccagacagaactggaccagcatcgagaacatcaaggagctcaaggccggctacatttcccaggtcgttcacaagatttgcgagctcgtcgaaaaatacgacgccgtgatcgccctcgaggacctcaactcagggttcaaaaacagcagggttaaggtggaaaagcaagtttaccagaagtttgaaaagatgctcatcgacaaactcaactacatggtggacaagaagagcaacccctgcgccaccggtggcgccctcaagggataccagattaccaacaagttcgaatccttcaaatctatgagcacacaaaatggcttcatattctacatccccgcctggctcacctcaaaaatcgaccccagcaccggtttcgtgaatctcctcaagacaaagtacacctctatcgcagactccaagaaatttataagcagcttcgatagaatcatgtatgtccccgaggaggatctcttcgaatttgctctcgattacaagaacttcagcaggaccgacgccgattatatcaagaagtggaagctctactcctacggcaacagaatcaggatcttcaggaaccccaagaagaacaatgtcttcgactgggaggaggtgtgccttacctccgcatacaaggagctcttcaacaagtacggcattaactaccagcagggcgacatcagggccctcctctgcgagcaatccgacaaggccttctactcctccttcatggctctcatgagcttgatgctccagatgaggaattccattaccggcaggactgacgtcgatttcctcatatcacccgtcaagaatagcgatgggatcttctacgactcaaggaattacgaggcccaggagaacgccattctcccaaagaacgctgacgccaacggcgcctacaacatcgctaggaaagtgctctgggccatcggtcagttcaagaaagccgaggacgagaagctcgacaaggttaagatcgccatcagtaacaaggagtggctcgaatatgcccagaccagcgttaagcac

SEQ ID NO: 83 - DNA, 3684 bp, Artificial
  synthetic
atgtccaagctcgaaaagttcaccaactgctactccctctccaaaacccttaggtttaaggccatcccagtgggaaagacccaggagaacatcgataataaaaggctcctcgtggaggacgagaaaagggctgaggactacaagggggtgaagaaattgctcgacaggtattatttgagcttcatcaacgatgttcttcacagcatcaagctcaagaatctcaacaactacatctcccttttcaggaagaagaccaggaccgagaaggagaacaaggagcttgagaacctcgagatcaacctcagaaaagagatcgccaaggccttcaagggcaacgaggggtacaagtccttgtttaagaaggacatcatcgagaccatccttcccgagttcctcgacgacaaagatgagatcgccctcgttaactcattcaacggttttactactgccttcaccgggttttttgacaatagggagaacatgttctctgaggaggccaagagtacctccatcgcattcagatgcattaatgagaatcttactagatacatatccaatatggacatattcgagaaggtggacgccatctttgacaagcacgaggtccaggagatcaaggagaagattcttaactctgattacgacgtcgaggacttcttcgagggagagttcttcaattttgtgctcactcaggagggcatcgacgtgtataacgccattatagggggttttgtcacagagtctggagaaaagatcaagggcctcaacgaatacatcaacctctataaccaaaagaccaaacagaaacttcccaaatttaagcccctctacaagcaggtcctctccgacagggaatccctttccttttacggggagggctacacctccgacgaagaggtgctcgaggtgttcaggaataccttgaacaagaacagcgagattttcagctccataaaaaagctcgaaaagctcttcaagaactttgacgagtactcctccgccggaatcttcgtcaagaacgggccagccatctccaccatcagtaaagacattttcggggagtggaacgttatcagggacaagtggaacgccgaatacgacgacatccacctcaagaagaaagccgtggtcaccgagaagtacgaggacgacaggagaaagtcttttaagaagatcgggagcttcagccttgagcagctccaagagtacgccgacgccgacctcagcgtggtcgaaaagcttaaggaaatcatcatccagaaggttgacgagatctataaggtgtacggcagcagcgagaagctcttcgacgctgattttgtgctcgagaaaagcctcaagaagaacgacgccgttgtggccatcatgaaggatctcctcgactcagtcaaaagcttcgagaactacatcaaggcatttttcggcgaggggaaggagaccaacagagacgaaagcttttacggggactttgtcctcgcctacgacatcctccttaaggtcgaccacatctacgacgccatcagaaactacgtcacccagaagccatactccaaggataagttcaagctctactttcaaaatccccaattcatggggggctgggacaaggacaaggaaacagactacagggccaccatcctcaggtatgggtctaagtactacctcgccatcatggataagaagtacgccaaatgtcttcagaagatcgacaaggacgacgttaacgggaactacgagaagatcaactacaagctcctccctggcccaaataagatgctccccaaggtcttcttctctaaaaagtggatggcctactacaacccctccgaagacatccagaaaatctacaagaacgggaccttcaagaaaggggacatgttcaaccttaacgactgccataaactcatcgacttttttaaggacagtatctccaggtaccccaagtggagtaacgcctatgacttcaatttcagcgagacagagaaatacaaggatatagccgggttttacagggaggtggaggagcagggctacaaagtcagcttcgaatccgcaagcaagaaggaggtggacaaactcgtggaggaagggaagttgtatatgttccagatttacaacaaggacttcagcgataagagccacgggacccctaaccttcacaccatgtacttcaagctcctcttcgacgagaacaatcacggccaaatcaggctcagcggcggagctgagctcttcatgaggagggcctctctcaaaaaggaggagcttgttgtccaccctgccaactctcccatcgccaacaagaatcccgacaaccccaaaaagaccaccaccttgagctacgatgtgtacaaggacaagaggttttccgaggaccagtacgagctccatatccctatcgctatcaacaagtgccccaagaacatcttcaagatcaacaccgaggtcagggtccttctcaagcatgacgacaatccctacgtcataggaatcgatagaggcgagaggaacctcctctacatcgtggtggtggacggaaaaggcaacatcgtcgagcagtactcactcaacgagatcatcaacaacttcaacggaatcaggatcaagaccgattaccacagcctcctcgacaagaaggaaaaagaaaggttcgaggccagacaaaactggaccagcatcgagaacatcaaggagcttaaagccggctatatctctcaggtcgtccacaagatctgcgagctcgttgagaagtatgacgccgtgattgctttggaggacctcaactccggtttcaagaacagtagagtcaaggtcgagaagcaggtttaccagaagttcgagaagatgcttattgacaaacttaactacatggtcgacaagaagagcaacccctgcgcaaccgggggagccctcaagggttaccagatcacaaacaagttcgagagcttcaagagcatgagcacccagaatggcttcatcttttatattcccgcctggctcaccagtaaaatcgacccctctacaggtttcgtcaacctcttgaagactaaatataccagcatcgcagacagcaaaaagtttatcagcagctttgataggatcatgtacgtgcccgaggaagacttgttcgaatttgccctcgattacaagaatttcagcaggaccgatgcagactacatcaagaagtggaaactctatagttacggcaataggatcagaatcttcagaaacccaaagaaaaacaacgtcttcgactgggaggaggtctgcctcacatctgcctataaggagctcttcaataagtacggaatcaattatcagcagggcgacataagggccctcctctgcgagcagagcgacaaagccttctattctagcttcatggccctcatgtcccttatgctccagatgaggaatagcatcactgggaggaccgacgtggactttctcatctcccctgtcaagaattcagacgggattttctacgattccaggaattacgaggctcaggaaaatgccatccttcctaaaaacgcagatgccaacggcgcctacaacatcgccagaaaggtgctttgggctatcggtcaattcaagaaagccgaggacgagaagctcgacaaggtcaagatcgctatcagcaacaaggagtggctcgagtatgcccaaaccagtgtcaagcac

SEQ ID NO: 84 - DNA, 3684 bp, Artificial
  synthetic
atgagcaagcttgagaagtttaccaattgctactctctcagcaaaaccctcaggttcaaggccatccccgtcgggaagacccaggagaacattgacaacaagagactcttggttgaagatgaaaaaagggccgaggactataagggggtgaagaaactcctcgacaggtactaccttagctttatcaacgacgtgctccacagcataaaattgaaaaatctcaacaattacatcagcctcttcaggaagaagaccaggaccgaaaaagagaacaaagagctcgagaacctcgagatcaacctcaggaaggaaatagcaaaagccttcaaaggcaatgagggctataagagcctcttcaagaaggacattatcgagaccatcctccccgagttcctcgacgacaaggacgagatcgccctcgtgaacagcttcaacggtttcaccaccgccttcaccggcttctttgacaacagggagaatatgttcagcgaggaggccaagtctacatcaatcgcctttaggtgcataaacgagaacctcaccaggtacatcagcaacatggacatcttcgagaaggtggacgccatcttcgataagcacgaggtgcaggagatcaaggagaagatcctcaacagcgactacgacgtcgaagactttttcgaaggggaatttttcaacttcgttctgacccaggagggcatcgacgtgtacaacgccattatcgggggtttcgtgaccgagtctggcgagaagatcaaggggctcaatgagtacatcaacctttataaccagaagaccaagcaaaagctccccaagtttaaacccctttacaagcaggtgttgagcgatagggagagcctctccttctatggggagggctatactagcgacgaggaagttctcgaagtgtttaggaacacccttaacaagaattctgagatcttcagctccatcaagaagctcgagaagttgttcaagaatttcgatgaatactcctccgccggcatctttgtcaagaatggccccgccatctccacaatctccaaggacatctttggtgagtggaacgttattagggacaaatggaacgccgagtacgatgacatccacctcaagaagaaggctgtggtgaccgaaaagtacgaggacgacagaaggaagtccttcaagaagatcggctcctttagcctcgaacagcttcaggaatacgccgatgccgacctctccgtcgttgaaaaactcaaagagattattatccagaaggttgacgagatctacaaggtttacgggtcctcagagaagctttttgacgccgattttgttctcgagaagagcctcaagaagaacgatgccgttgtcgccatcatgaaagatctcctcgatagcgtcaagagcttcgaaaactacatcaaggccttctttggcgaggggaaagaaaccaacagggacgagtcattttatggggacttcgtcctcgcctacgacatccttctcaaagttgaccatatctatgatgccatcaggaactacgttacccagaagccctacagcaaggacaaattcaaactctacttccagaacccccaatttatggggggctgggacaaggacaaggaaaccgactacagggccactatccttaggtacgggagcaaatattatctcgcaatcatggataagaagtacgccaagtgtctccaaaagatcgacaaagacgacgtgaatgggaattacgagaagatcaattacaagctcctccccggtccaaacaagatgctccccaaggtgtttttctcaaagaagtggatggcctactacaacccctccgaggatatccaaaagatctacaaaaacggcacttttaagaagggggatatgttcaatctcaacgactgccacaagctcatcgactttttcaaggacagcattagcaggtaccccaagtggagcaacgcatatgatttcaattttagcgagaccgaaaagtacaaggacatcgctggcttctacagggaggtcgaagagcaggggtacaaggtctctttcgagtccgcctccaagaaggaggtggacaaattggtggaggaggggaaactttacatgtttcagatctacaacaaggatttctccgacaagtcccatggcacccccaacctccacaccatgtacttcaagcttctcttcgacgagaataatcacgggcaaatcaggctttccggcggcgcagagctcttcatgaggagagcctccctcaagaaagaggagctcgttgtgcaccccgccaactcccccatcgccaacaagaacccagataatcccaagaagaccaccaccctcagctacgacgtctacaaggacaaaaggttctcagaggaccagtatgagctccacatccctatcgccatcaacaagtgccccaaaaatatctttaagataaacaccgaggtgagagtgttgttgaaacacgacgataacccctacgtcattggaatcgacaggggggagaggaacctcctctacatagtcgtggtcgacggcaaaggtaacatcgttgaacaatactccctcaatgagatcattaacaacttcaatgggatcaggataaagaccgactatcacagcctccttgacaagaaggagaaagagaggtttgaagctagacaaaactggacttccatagagaacatcaaagagctcaaggccggctacatctcccaagtggtgcacaaaatctgtgagctcgtcgagaagtacgacgccgtcatcgccctcgaggacctcaactccgggttcaagaacagtagagtcaaggttgagaagcaagtctaccagaagtttgagaagatgcttatcgataagcttaactacatggttgataagaaatctaacccctgcgctactggcggcgccttgaaggggtaccaaatcaccaacaagttcgagagcttcaagagcatgtccactcagaacggattcatcttctacatacccgcctggctcacttccaaaatagaccccagcaccggtttcgttaacctcttgaagaccaagtatacctcaatcgcagacagtaagaagttcatttccagcttcgatagaataatgtacgtccccgaggaggacttgttcgagtttgctttggactataagaacttctcaaggacagacgccgactacatcaaaaagtggaagctctacagctatgggaacaggatcaggatatttaggaaccccaagaaaaacaacgtctttgattgggaagaggtgtgtttgaccagcgcatacaaggagcttttcaacaagtacgggatcaactatcagcagggcgacatcagggccctcctttgcgaacaatccgacaaggccttttattccagtttcatggccctcatgagtttgatgttgcagatgaggaactccatcactggtaggaccgacgtggacttcttgatcagccccgtgaaaaactccgacggaatcttctacgacagcagaaactatgaggcccaggagaatgcaattctccccaagaacgccgacgccaatggggcatataacatcgccaggaaggtgctttgggccataggccaatttaaaaaggcagaagacgagaaacttgacaaggtgaagatcgccataagcaataaagagtggctcgaatacgctcagacctcagtcaaacac

SEQ ID NO: 85 - protein, 1263 aa, Unknown
  bacterial
MNNGTNNFQNFIGISSLQKTLRNALIPTETTQQFIVKNGIIKEDELRGENRQILKDIMDDYYRGFISETLSSIDDIDWTSLFEKMEIQLKNGDNKDTLIKEQTEYRKAIHKKFANDDRFKNMFSAKLISDILPEFVIHNNNYSASEKEEKTQVIKLFSRFATSFKDYFKNRANCFSADDISSSSCHRIVNDNAEIFFSNALVYRRIVKSLSNDDINKISGDMKDSLKEMSLEEIYSYEKYGEFITQEGISFYNDICGKVNSFMNLYCQKNKENKNLYKLQKLHKQILCIADTSYEVPYKFESDEEVYQSVNGFLDNISSKHIVERLRKIGDNYNGYNLDKIYIVSKFYESVSQKTYRDWETINTALEIHYNNILPGNGKSKADKVKKAVKNDLQKSITEINELVSNYKLCSDDNIKAETYIHEISHILNNFEAQELKYNPEIHLVESELKASELKNVLDVIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPDKKIIEGNTSENKGDYKKMIYNLLPGPNKMIPKVFLSSKTGVETYKPSAYILEGYKQNKHIKSSKDFDITFCHDLIDYFKNCIAIHPEWKNFGFDFSDTSTYEDISGFYREVELQGYKIDWTYISEKDIDLLQEKGQLYLFQIYNKDFSKKSTGNDNLHTMYLKNLFSEENLKDIVLKLNGEAEIFFRKSSIKNPIIHKKGSILVNRTYEAEEKDQFGNIQIVRKNIPENIYQELYKYFNDKSDKELSDEAAKLKNVVGHHEAATNIVKDYRYTYDKYFLHMPITINFKANKTGFINDRILQYIAKEKDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPDKLKNVGHQCGCIFYVPAAYTSKIDPTTGFVNIFKFKDLTVDAKREFIKKFDSIRYDSEKNLFCFTFDYNNFITQNTVMSKSSWSVYTYGVRIKRRFVNGRFSNESDTIDITKDMEKTLEMTDINWRDGHDLRQDIIDYEIVQHIFEIFRLTVQMRNSLSELEDRDYDRLISPVLNENNIFYDSAKAGDALPKDADANGAYCIALKGLYEIKQITENWKEDGKFSRDKLKISNKDWFDFIQNKRYL

SEQ ID NO: 86 - DNA, 3789 bp, Artificial
  synthetic
atgaacaacggaacaaataacttccaaaacttcattggcatcagctcactccagaagaccttgagaaatgcacttattcctacagagactacacaacaatttatcgtgaagaatggaatcattaaggaggacgaactccgcggagaaaaccgccaaattcttaaagacataatggatgattactatagaggatttatttccgagacactgtcaagcattgatgatatcgattggacttcactttttgagaagatggaaattcagctgaagaatggcgataacaaagatactcttattaaggaacaaacagagtatcgcaaagcaatacacaaaaagtttgctaatgacgatagattcaagaatatgttctcagcgaagctgatttccgatattctccccgagtttgtgattcacaacaataattactcggcttctgagaaagaggaaaaaactcaggttataaagttattctcacgctttgcaactagctttaaagattattttaaaaacagagccaactgtttcagtgcggatgatatttcctcatcatcctgtcaccggattgttaacgataatgcggaaatctttttcagcaacgctctagtttacagacgcattgtcaaatcgctgtcgaacgatgatattaacaagatcagcggcgatatgaaggatagtttgaaggagatgagcctcgaggaaatttattcttacgagaaatatggggaatttattactcaagagggtattagtttttacaatgacatatgcggtaaagtcaattcctttatgaatttgtattgccagaaaaacaaggaaaataaaaatttgtacaaattgcagaagctccataagcagattctctgcatcgctgacacgtcttacgaagttccttacaaattcgagtctgacgaggaagtttatcagtccgttaacggtttcttggataacatcagttctaaacacattgttgaaaggcttcggaaaattggagacaattacaatgggtacaacttagacaagatttatattgtttcgaaattctatgagagcgtctcacaaaagacataccgtgattgggaaaccattaacactgcacttgaaatccattacaataacattcttcctggaaatggaaagtctaaggccgacaaggtgaaaaaggctgtcaaaaatgatctacagaaaagtattaccgaaataaatgagctcgttagcaactataaactttgttcagatgataatataaaggccgaaacctatatacacgaaatcagtcacattttgaacaactttgaagctcaggaactgaagtataatcctgaaatccatctagtggaatctgaacttaaggcatccgagctaaaaaatgtccttgacgttataatgaatgcgttccactggtgtagcgtttttatgacggaggagctagtggataaagataacaacttctacgcagagttagaagaaatctacgatgagatatatcctgtcattagtttgtataatcttgtcaggaattatgtgacacagaaaccatactctactaaaaaaattaagcttaactttggaattccgacactcgctgacggctggtccaagtctaaggagtactctaataatgcaatcatattgatgagggacaacttatattatctgggcatatttaatgccaaaaacaagccagataagaaaattatcgaggggaacacgtctgaaaacaagggagattacaaaaaaatgatttataacctcttgcctgggccaaataagatgataccaaaagtttttctaagttctaagacaggcgtggaaacttataagccttcagcgtatatacttgaaggatacaaacagaataagcatatcaagtctagcaaggatttcgacatcactttttgccatgacttgatcgattattttaaaaactgtatagcaatacatcctgagtggaagaacttcggattcgatttttccgatactagcacctatgaggacatttctggtttctacagagaagttgagctgcagggctataaaatagattggacatatatcagtgagaaagacattgatctactccaggagaaagggcagctctacttgtttcagatctacaacaaggatttttcaaaaaagtcaactggaaatgacaatttgcacaccatgtacttgaaaaatctttttagcgaagaaaatcttaaggacattgtattaaaactgaacggagaggctgagattttttttaggaagagctccattaagaacccaatcattcacaagaaagggagtatcctggtcaacagaacctatgaagctgaggaaaaagatcaattcggaaatattcagatcgtccgcaaaaatatacctgagaacatctaccaagaactatacaaatattttaatgacaagtccgataaggagctttccgatgaggccgctaagctgaaaaacgtggttggtcaccacgaggcggccactaacattgttaaagactaccgttatacttatgacaagtactttttgcatatgcctattacaatcaacttcaaggcaaacaagaccggctttatcaatgacaggattcttcagtacatcgcaaaggagaaggatctacacgtgatcgggatagatagaggagagagaaacttgatctatgtgagtgtgattgatacatgtgggaatattgtcgaacagaaatcattcaacattgtgaatggctacgattaccaaattaagctgaagcagcaagagggagcaagacaaatcgctcgcaaggaatggaaggagatcggaaagatcaaggagataaaagaaggctatctcagcctcgtaatccacgagatttcaaagatggtgattaagtacaatgcaatcattgccatggaggatctctcgtacggattcaaaaaaggtaggttcaaggttgaacgacaagtctaccagaaatttgagacgatgttaatcaacaaattgaactacctcgtatttaaggatattagtattactgaaaatggtgggcttttgaagggttatcagttgacctacattccagacaagctcaagaatgtgggacaccaatgtggctgcattttttacgtgcccgcagcatatacttctaaaattgatcctaccacaggattcgtaaatatctttaaattcaaagatcttaccgttgacgctaagagggagtttattaagaaattcgactctattcgctatgatagtgaaaagaatctcttttgcttcacatttgattacaacaacttcataacccaaaacactgtgatgagcaagagcagttggtctgtttacacctacggagttcgtattaagaggcgatttgtcaatggtcggttctctaatgaatcagacacaattgatatcactaaagatatggaaaagactcttgaaatgacagatattaactggagagatggacacgatttaaggcaagatattatagattatgaaattgtgcaacatatttttgaaatatttaggttgacggtacaaatgcgcaactcattgtcagaacttgaggatagagactatgatcgtttgatatcccctgttctcaatgaaaataatatcttctacgattcagctaaggcaggggacgcgcttcctaaagatgctgatgcgaatggagcttactgtattgcgctaaaaggcttgtatgagataaagcaaattaccgaaaactggaaagaggatggaaaatttagtcgagataagctcaaaatatcaaacaaagattggtttgacttcattcagaacaaaaggtacctc

SEQ ID NO: 87 - DNA, 3789 bp, Artificial
  synthetic
atgaacaacgggaccaacaacttccagaatttcatcggcatctcctctctccagaagaccctcaggaacgccctcattccaacagagaccacacaacagttcatcgtcaagaacgggatcataaaggaggacgagcttaggggagagaacaggcaaattcttaaggacatcatggacgattactacaggggcttcatcagtgagaccctcagctccatagacgacatcgactggacctccctctttgagaagatggagatccagttgaagaacggggacaacaaggatacactcatcaaggagcaaaccgagtacagaaaggccatccataagaagtttgccaacgacgacaggttcaagaacatgttcagcgccaaattgatcagcgacattctccccgagttcgttatccacaataataactacagcgcctccgagaaagaggagaagacccaggtgatcaagctcttttccaggttcgcaaccagtttcaaggactacttcaagaacagggctaactgcttcagcgccgacgacatctcctcctcatcctgccacaggatagtcaatgacaatgccgagatcttcttctccaatgccctcgtttacagaaggattgtgaaaagcctctccaatgacgacatcaacaagatctccggtgacatgaaagacagtctcaaggaaatgtcactcgaggagatttacagttatgagaagtacggtgaatttatcactcaggaggggatctccttctataacgatatttgcggtaaggttaacagcttcatgaacctctactgtcagaaaaacaaggagaataagaacttgtacaagttacagaagctccacaaacaaatcttgtgtatagccgataccagctacgaagtgccctataagttcgaatccgacgaagaggtgtatcagtccgttaatggttttctcgataacatctcctccaaacacatcgtggagaggttgagaaagatcggggacaactataatggctacaacctcgataaaatatacatcgttagcaagttctatgagagcgtttcccaaaaaacctacagagactgggagaccatcaacaccgcccttgaaatccactataacaacatcttgcccggcaacggtaagtccaaggccgacaaggtgaagaaggccgtcaagaatgatttgcagaagagcatcaccgagataaatgaactcgtctccaactataagctctgctccgatgacaacatcaaagccgagacatacattcatgagatttcccacatccttaacaattttgaggcccaggagctcaagtacaaccccgagatccacctcgtcgaaagcgagctcaaggccagcgagcttaagaacgtgctcgatgtgataatgaacgccttccattggtgctccgtcttcatgactgaggagctcgtcgacaaggataataacttctacgccgagctcgaggagatctacgacgagatctaccccgtcatctccctctataacctcgttaggaactacgtcactcaaaagccctattccaccaagaagatcaaattgaactttggcatacccacactcgccgacggctggagtaagtccaaggagtattcaaataatgccatcatcctcatgagggataacctctactacttgggcatctttaacgccaagaataaacctgacaagaagatcatcgaggggaatacctccgagaacaagggagattataagaagatgatttacaatctcctccctgggcccaacaaaatgatacccaaggtgtttctctcatccaagaccggcgtcgagacatataagcctagcgcctatatacttgaaggctacaaacagaataagcacatcaagtcttccaaggacttcgatatcacattctgccacgatctcatcgactacttcaaaaactgcatcgcaattcatcctgagtggaagaattttgggtttgatttctccgataccagcacttacgaggacatatccggcttctacagggaagtcgagctccagggatacaagatagactggacatacatttctgagaaggacatagaccttttgcaggagaaggggcagctctacctcttccagatttataacaaggacttcagtaagaaaagcaccgggaacgacaacctccataccatgtacctcaagaaccttttcagtgaagaaaacctcaaggacatagtgctcaagcttaatggcgaggctgaaatcttcttcaggaagtcttcaatcaagaatcccatcatccataagaagggcagtatccttgtgaataggacctacgaagccgaggagaaggaccagttcggcaacattcagatagtcaggaaaaatatccccgagaacatctaccaggaactctataagtacttcaacgacaagagcgacaaagagctcagcgacgaggccgccaagctcaagaacgtcgtcgggcaccatgaggccgccaccaatatcgttaaggactacaggtacacttatgacaagtatttcctccacatgcctatcacaattaatttcaaggcaaacaagaccgggtttatcaacgacaggatcctccagtacatcgccaaggagaaagacttgcatgttatcggcattgacaggggcgaaaggaatctcatctacgttagcgtgatagacacctgcggcaatatcgtcgagcagaagtctttcaacattgtcaacggctacgattaccagatcaagctcaagcaacaggagggggccaggcagatcgccaggaaggagtggaaggaaatcgggaagatcaaggagatcaaggaggggtatctctctctcgtcatccacgaaatctcaaagatggttatcaagtataacgccatcatcgctatggaagacttgtcctacgggttcaagaagggcaggttcaaggttgagaggcaagtgtatcagaagtttgagacaatgctcatcaacaaactcaactatctcgtgttcaaggacatctccatcactgagaacggtgggctcctcaaagggtaccagctcacctacatccctgataagctcaaaaatgtcggccaccaatgcggctgcatcttctacgtccccgccgcctacacatctaagatcgaccccaccaccgggtttgtgaacatcttcaagttcaaggacctcacagtggacgccaaaagagaattcatcaagaaatttgactccatcaggtacgatagcgagaaaaacttgttctgcttcacatttgactataacaactttataacccagaatacagtgatgagcaaaagctcctggagcgtgtacacatacggcgtgaggatcaagagaaggttcgttaacgggaggttctccaacgagtccgacaccatcgacattaccaaggacatggaaaaaaccttggagatgactgacatcaactggagagacgggcacgacctcaggcaggacatcatcgattacgagatcgtgcagcacattttcgaaatctttagattgacagttcagatgagaaactccctctccgagctcgaggacagagattacgacaggctcataagccccgtgctcaacgagaacaacatcttttacgactccgccaaggccggggacgcacttcccaaggacgctgacgccaacggggcctactgcatcgcactcaaaggcctctatgagataaaacagatcaccgaaaactggaaggaggacggtaagttcagcagggacaagctcaaaatatctaataaagactggttcgatttcatccaaaacaagaggtacttg

SEQ ID NO: 88 - DNA, 3789 bp, Artificial
  synthetic
atgaataatgggactaacaacttccagaacttcatcggtattagcagtctccagaagaccctcaggaacgccctcattcccaccgagaccacccagcagtttatcgtgaagaacggcatcataaaggaggacgagctcaggggcgaaaataggcagattctcaaggacatcatggatgattactacaggggattcatctccgaaactctctcctctatagatgatatcgactggaccagtctcttcgaaaagatggaaatccaactcaagaacggcgacaacaaggatacacttatcaaagagcagactgagtacagaaaagctatccacaagaagttcgccaacgatgacaggtttaagaacatgttctccgctaagctcatttctgacattctccctgaatttgtcatccacaacaataattacagtgcctctgagaaggaggagaaaacccaagtgattaagctcttcagcaggttcgccacatcattcaaagactacttcaagaatagggccaactgcttctccgccgacgatatcagctcctcaagttgccacaggatcgtgaatgataacgccgagatcttcttcagcaacgccctcgtctacaggaggatcgtcaaatccctctcaaatgatgacatcaacaagatcagcggggacatgaaggacagtctcaaggagatgagccttgaggagatctactcctatgagaagtacggggagttcataacccaagaggggatctccttctacaacgacatctgcggaaaagtgaacagctttatgaacctctactgccagaaaaacaaggagaacaagaacctctacaagctccagaagctccacaaacagatcttgtgcatcgcagatacctcttacgaggtgccctacaagttcgagtccgacgaagaggtctaccaaagcgttaacgggtttctcgacaacatcagctctaagcacatcgtggaaagactcaggaagattggtgataactacaacgggtataatctcgataaaatctatatagtgtccaagttctatgagagcgtgagccagaagacctacagggactgggagaccatcaacacagccctcgagatccactataacaacatcctccccgggaacgggaagtccaaggccgataaggttaagaaagccgtcaagaacgacctccagaagagcataaccgagatcaatgagctcgtctccaactacaagctctgctctgatgacaatatcaaggctgagacctacatccacgagatcagtcacatcctcaataacttcgaagcccaggagctcaagtacaacccagaaatccacctcgtcgagtccgagctcaaggcatctgagctcaagaacgtcttggacgtgattatgaacgccttccattggtgcagtgtcttcatgaccgaggagttggtggacaaggacaataacttctacgccgagctcgaggagatctatgacgagatctatcccgttatcagtctctacaacctcgttaggaactatgtgacccagaagccctactccacaaagaagatcaagctcaacttcgggatccccactttggccgatgggtggagcaagagcaaggagtactccaacaatgcaattatcctcatgagggacaatctctactacctcgggatctttaacgccaaaaataagcccgacaagaagatcatcgaggggaacacctccgaaaacaagggggactacaagaagatgatctataatctcctccccggtcccaacaagatgattcccaaggtgtttctcagttccaagaccggcgttgagacctacaaaccctctgcatacatccttgagggctacaagcagaataaacacatcaaatcctctaaagacttcgacatcaccttctgccacgacttgatcgactacttcaagaactgcattgccatccaccccgagtggaagaacttcggtttcgacttttccgataccagcacctacgaggacatcagcggtttttacagggaagttgagcttcagggctacaagatcgactggacctacatctccgagaaggacatcgacctcttgcaggagaaggggcagctctatctcttccaaatctataacaaggactttagcaagaagtccaccgggaacgacaacttgcacaccatgtacctcaaaaacctcttttccgaggaaaacctcaaggacatcgtgttgaagctcaatggcgaggccgagatcttcttcaggaagtcttcaatcaagaaccccatcatccacaagaaggggtcaatccttgttaatagaacttacgaagctgaagagaaggaccaatttgggaacatccagatcgtcaggaagaatatccctgagaacatctaccaggaactctacaaatacttcaacgacaagagcgacaaggagctctccgacgaggccgccaagctcaagaatgttgtgggccaccacgaagctgccaccaacatcgtcaaagactacaggtacacttatgacaagtactttctccacatgcccattaccatcaatttcaaagccaacaaaaccggcttcatcaacgacaggattctccagtacatcgccaaagagaaggacctccatgttatcgggatcgaccggggagagagaaacctcatctacgttagcgtcatagacacctgtgggaacatagtcgaacaaaaaagcttcaacatcgttaacggatacgattaccagatcaagctcaagcaacaggagggtgcaaggcagatcgccaggaaggagtggaaggagatcgggaagattaaggagatcaaggagggctacctctcccttgtgatccacgagatatccaaaatggtgataaagtataacgcaattatcgccatggaggacctcagctatgggttcaaaaaaggcaggttcaaggtggagaggcaagtgtaccagaagtttgaaaccatgttgatcaacaagctcaactacctcgtgttcaaggacatcagcatcaccgagaatggtggcctcctcaagggctaccagctcacctacatccccgataaacttaagaacgtgggccaccagtgcgggtgcatattctatgtccccgctgcctacaccagtaaaatcgacccaaccaccgggttcgttaacatctttaagttcaaggacctcaccgttgacgcaaaaagggagttcatcaaaaaattcgacagcatcagatacgacagcgaaaagaatcttttctgcttcacctttgactacaacaatttcatcactcagaacactgtcatgtctaagagcagctggtcagtgtacacctacggagtgaggatcaagagaagattcgtcaacgggagattcagtaatgagagtgacaccattgacataacaaaagacatggagaagacactcgagatgaccgatatcaattggagggatgggcatgacctcaggcaggacatcatagattacgaaatcgtccagcacatcttcgagattttcagactcacagtgcagatgaggaatagtctcagcgagctcgaggacagggactacgacaggttgatctcccccgtgctcaacgagaataatatcttctacgactctgccaaggccggcgacgccctccccaaagacgcagacgcaaacggggcctactgcatcgcactcaaggggctctacgagatcaagcagatcaccgagaattggaaggaggacgggaagttctccagggacaaacttaagatcagtaacaaggactggttcgacttcatccaaaataagaggtacttg

SEQ ID NO: 89 - DNA, 3789 bp, Artificial
  synthetic
atgaacaacggaaccaacaacttccaaaatttcatcggtatctcctcccttcagaagacactcaggaacgcccttatccccaccgaaacaacacagcagttcatcgtgaagaatggaatcatcaaggaagacgagctcaggggggagaataggcagattctcaaggatattatggacgattactacaggggcttcatcagcgaaaccctcagcagtatcgacgacatcgactggactagcctcttcgagaagatggagatccagctcaagaacggtgacaataaagacaccttgatcaaggagcaaaccgaatataggaaggccatccacaagaaatttgccaacgacgacagattcaagaacatgttctccgccaaactcatctccgatatcctccccgaattcgtcatccacaataataactactccgccagcgagaaggaggagaagacccaggtcatcaaactcttcagcaggttcgccacatcctttaaggactactttaagaacagggccaactgcttctccgctgacgacataagctccagctcctgccacaggattgtcaatgacaacgcagaaatcttcttctccaatgccctcgtctacaggaggatcgtgaagtccctcagcaatgacgacatcaacaagatctccggggacatgaaagactcactcaaggaaatgagtctcgaggagatctacagttacgagaagtatggcgaatttataacccaggaaggtattagtttctacaacgacatctgcgggaaagtcaacagcttcatgaacctctattgtcagaagaacaaggagaacaaaaacctctacaagctccagaagctccacaagcagatcctctgtatcgctgacaccagctacgaggtcccctataagttcgagtccgatgaggaggtgtatcagagcgtgaatggctttctcgacaacatatccagcaagcacatcgtcgagaggctcaggaagatcggcgacaattacaacgggtacaacctcgacaagatctacatcgtgtcaaagttttacgagagcgtgtcacaaaaaacctacagggactgggaaacaatcaataccgccctcgagatccactacaacaatatcctccccggcaacggtaagagcaaggccgacaaagtgaaaaaggccgtgaaaaacgacctccagaagagcatcaccgagatcaacgagctcgtctccaattacaagctttgctccgatgataacatcaaggccgaaacctacatccacgaaatttcccacatcctcaataactttgaggcccaggagctcaagtacaatcccgaaatccacctcgtcgagtccgaactcaaggcctccgaactcaaaaacgtcctcgacgtcatcatgaacgcctttcactggtgctccgtttttatgaccgaggagttggtggacaaagacaacaacttctacgccgaacttgaggaaatctatgacgagatctatcccgtcatcagcctctacaatctcgtgagaaactacgtgacccagaagccctactcaaccaaaaagattaagctcaacttcggcattcccaccctcgccgacggctggagcaagtccaaggagtactccaacaatgccataatcttgatgagagataatttgtactacctcgggatcttcaacgccaagaacaagcccgacaagaaaattatagagggcaacacctccgagaacaagggggattacaagaagatgatctataacctccttcccggtccaaacaagatgatccccaaggtgttcctctccagcaagactggtgtggagacctacaagccctcagcctatatcctcgaggggtacaaacagaacaaacacatcaagagctctaaggacttcgacattaccttctgtcatgacctcatcgactattttaagaactgcatcgctatccaccccgaatggaagaacttcggtttcgacttcagcgacaccagcacctacgaggacataagcgggttctatagagaggtcgagctccagggatataagatcgattggacctacataagtgaaaaggacattgatttgctccaggagaagggccagctctatctcttccagatttataataaggacttctctaagaagagcaccggcaacgataacctccacaccatgtacctcaagaacctcttctccgaggagaacctcaaggatatcgtgctcaagctcaacggggaggccgagattttcttcaggaagagcagcatcaaaaaccccatcatccacaagaaggggagcattctcgtgaacaggacctacgaggccgaggagaaggaccagttcggtaacatccagatagtgaggaaaaacatccccgagaacatctatcaagagctctacaaatatttcaacgacaaatctgacaaggagctctccgacgaggccgccaagcttaagaacgttgttgggcaccacgaggccgccaccaatatcgtcaaagactacagatatacatacgacaagtacttcctccacatgccaattaccatcaatttcaaggccaacaagaccggcttcatcaacgacagaatcctccaatacatagctaaggagaaggacttgcatgtcatcggtatcgacaggggggaaaggaacctcatctacgtcagcgttatagacacctgcggaaacatcgtcgagcagaagtccttcaatatcgtcaacggctacgactaccagataaagctcaagcagcaggaaggggcaagacagatcgccagaaaggagtggaaagagatcggcaagatcaaggagatcaaagaggggtacctcagccttgtgatccatgagatcagcaagatggtcatcaagtacaacgctataatcgccatggaggacctctcctatgggttcaagaagggcagatttaaggtggagaggcaggtctaccaaaaattcgagaccatgctcataaacaagctcaattatttggttttcaaagacatcagcattacagagaatggcgggctcctcaaagggtatcagcttacctacattcccgacaagctcaagaacgtcggccaccagtgcgggtgcatcttctacgtccccgccgcctacacctccaaaatcgaccccaccaccggcttcgtgaacatctttaagttcaaggacctcaccgtggatgccaaaagggagttcatcaagaaattcgacagtatcagatatgactcagaaaagaacctcttctgcttcacttttgactataacaacttcataacccagaacaccgttatgagcaagagtagctggtccgtgtatacctacggcgtcagaatcaagaggagatttgtgaacggtaggttcagcaacgagagtgacaccatcgacatcaccaaggatatggagaagaccctcgaaatgaccgacatcaattggagggatggacacgacctcaggcaagacatcatcgattacgagatagttcagcacatcttcgaaatatttaggttgaccgttcagatgaggaattccctcagcgagctcgaggatagagactacgacagacttatcagccccgttctcaacgagaacaacattttctacgactcagcaaaggccggcgacgccctccccaaggacgccgacgccaatggcgcctattgcatcgccctcaagggtctctacgagatcaagcagatcaccgaaaattggaaggaagacggcaagttcagcagagacaagctcaaaatatcaaacaaggattggttcgatttcatacagaacaagcgatacctc

SEQ ID NO: 90 - DNA, 3789 bp, Artificial
  synthetic
atgaacaatgggactaacaacttccagaacttcatcggcatctcatccctccagaaaaccctcaggaacgccctcatccccaccgagacaacccagcaatttatcgtcaaaaacggtatcatcaaagaagacgaactcagaggtgagaacaggcagatcctcaaggacattatggacgactattacagaggcttcatctcagagaccctcagtagtatcgacgacatcgactggacctctttgtttgagaagatggagattcagctcaagaatggagacaataaggacactctcatcaaggagcaaaccgagtacagaaaagccatacacaagaaatttgccaacgacgacaggttcaagaacatgttcagcgcaaagctcattagcgacatactccctgagtttgtgatccataacaacaactactccgcttccgagaaggaggaaaagacccaggttataaagcttttcagcagattcgccacctctttcaaggattactttaaaaatagggccaactgcttttccgccgatgatatcagttccagcagctgtcataggatcgtgaatgataacgccgagatcttcttcagcaatgccctcgtctacaggaggatcgtgaagagcttgtccaacgacgacatcaacaagatctccggggacatgaaggacagcctcaaggaaatgagcctcgaggagatctactcttatgagaagtacggcgagttcatcacccaggaaggcatatcattttacaacgacatttgcggcaaggtgaacagtttcatgaacctctactgtcagaaaaacaaggagaataaaaacctctacaagctccagaaattgcacaaacagattctctgtatcgccgataccagctacgaggtcccctacaaattcgagagcgatgaggaggtctaccagtccgttaacggctttctcgacaacatctcctctaaacacattgtcgagaggttgagaaagatcggcgacaactataacggctataatctcgacaagatctacatcgtgagtaagttctacgagagcgttagtcagaagacctacagggactgggagaccatcaacacagctctcgaaatccactataacaatatcctccccgggaacggtaagagcaaggcagacaaggtgaagaaggccgtgaagaacgaccttcagaagtccatcaccgagatcaacgagttggtgagcaattacaagctctgctccgacgacaacatcaaagcagagacctacatccacgaaatcagccacatcttgaacaacttcgaggcccaggagttgaaatacaaccccgaaatccacctcgttgagagtgaactcaaagccagtgagctcaagaacgtcctcgacgttattatgaacgccttccactggtgctctgttttcatgaccgaggagctcgtcgataaagataacaacttctacgccgagctcgaagagatatacgatgagatataccccgtcatctccctctacaatctcgttaggaattatgtcacccaaaagccctactctaccaagaagattaagctcaacttcggaatccccaccctcgccgacgggtggagcaagagcaaggagtactctaacaatgccatcatccttatgagggacaatctctactacctcggtatcttcaatgccaagaacaagcccgacaagaaaatcatcgagggcaacacctccgagaataaaggggactacaagaagatgatctataatctcctccccgggcccaacaagatgatccccaaagtctttctctcctcaaaaaccggggtggaaacttacaagccctccgcctacatcctcgagggctacaagcaaaacaaacacatcaagtcctccaaggacttcgacataacattctgccacgacctgatcgactacttcaagaattgcatcgccatacacccagaatggaaaaacttcgggtttgacttcagcgacacaagcacctacgaggatattagtggcttctatagagaagttgagctccagggatacaagatcgactggacctacatcagcgagaaggacattgacttgctccaggagaaggggcaactttacctcttccagatctataataaggacttctccaaaaagtccaccggcaatgacaacctccacacaatgtacctcaagaaccttttcagtgaggagaacctcaaagacatcgtcctcaaattgaacggcgaggccgaaatcttcttcaggaagtccagcatcaagaatcccatcatccataagaaggggagcatcttggttaacaggacctatgaggccgaggagaaggaccagtttggcaacatccagatagtgaggaaaaacatccccgagaacatttaccaggagctctacaagtatttcaacgacaaatccgacaaggaattgagtgacgaggctgccaagctcaagaacgttgtggggcaccatgaggccgccaccaatatagtcaaagactataggtacacctacgacaagtacttcctccacatgcccattaccatcaacttcaaagctaacaagaccgggttcataaacgacaggattctccagtacattgccaaagagaaggacctccacgtcatcggcatcgacaggggagagaggaacttgatctacgtgagcgtcatcgacacatgcgggaacatcgtggaacagaagtcttttaacatcgtcaacgggtacgactaccagatcaagctcaagcagcaggagggggccaggcagatcgctagaaaggagtggaaggagatcgggaagatcaaggaaattaaggaggggtatttgtccctcgtgattcacgagatctccaagatggtcatcaaatacaatgccatcatcgccatggaggacctcagctacggatttaagaagggcaggttcaaagtggaaaggcaagtctaccaaaagttcgagaccatgctcatcaacaagctcaattatcttgtatttaaagatatcagcatcaccgagaacggaggcctcttgaaaggctaccaactcacctacatccccgacaagttgaagaatgttgggcaccagtgcggctgcatcttctacgtgcccgccgcctacacatcaaagatcgacccaactaccgggttcgtgaacattttcaagtttaaggatctcaccgtggacgccaaaagggagttcatcaagaaattcgacagcatcaggtatgacagcgagaagaatctcttttgttttaccttcgactacaacaacttcatcacccagaacaccgtcatgtccaagtccagctggagcgtctacacctatggtgtgaggatcaagaggaggtttgttaacgggaggttttctaacgagtcagacaccatcgatataaccaaagacatggagaaaacacttgagatgaccgacatcaactggagagacggccacgaccttaggcaggacatcatcgattacgagatcgtccaacacattttcgaaatcttcaggctcaccgttcaaatgaggaactccctcagcgagcttgaggacagggactatgacaggctcatcagtcccgttctcaacgagaataacatcttctacgatagcgcaaaggccggcgacgccttgcccaaggacgctgatgccaatggcgcctactgtatcgccttgaaaggcctctacgagatcaagcagatcaccgagaactggaaagaggacggtaagttcagcagggacaaactcaaaatcagtaataaggactggtttgattttatccaaaacaagaggtacttg

SEQ ID NO: 91 - DNA, 3789 bp, Artificial
  synthetic
atgaataacgggaccaataattttcaaaacttcatcggcatttccagcctccagaagaccctcaggaacgcactcatacccaccgagaccacccagcagttcatcgtcaaaaacggcatcatcaaggaggacgagttgaggggcgagaacaggcaaatactcaaagacatcatggatgactactacaggggcttcatctcagagaccctcagttctatcgacgacatcgactggacatctctcttcgaaaagatggagattcagcttaaaaatggggacaacaaggacaccctcatcaaggaacagaccgagtacaggaaggcaattcacaaaaagttcgccaacgatgacaggttcaagaacatgttctccgccaagctcatcagcgatatcctcccagagttcgtcattcacaataataactatagcgcctccgagaaggaagaaaagacacaggttatcaaactcttcagcaggttcgctacctcatttaaggactacttcaagaacagggccaactgcttttccgctgacgatatcagctcctcctcttgccataggatcgttaacgacaatgccgagatctttttctcaaacgccttggtttataggaggatcgtgaagagcttgtctaacgatgatatcaacaagatctctggcgacatgaaggactcactcaaggagatgtctttggaggagatctattcttacgagaagtatggggagttcataactcaggagggcatcagcttctacaacgacatctgtggcaaggtcaactccttcatgaacctctactgccaaaagaacaaggagaacaagaacctctataaactccagaagctccacaagcaaatcctctgcattgcagacacctcatacgaagttccctacaagttcgagagtgatgaggaggtgtaccagagcgttaacgggttcctcgataacatcagctccaagcacattgtggaaaggttgaggaagataggagacaactataatggctacaacctcgacaagatctacatcgtgtctaagttctacgaaagcgtgagccagaagacatacagggattgggagaccattaacaccgctctcgagatacattacaacaacatcctccccggcaacggcaagtcaaaggccgacaaggttaaaaaggctgtcaagaacgatctccagaagtccatcaccgagataaacgagctcgtgagcaactacaaactctgcagcgacgacaacatcaaagccgagacctacatccatgagatttcccacatccttaataactttgaggcccaagagctcaagtataaccctgagatccacctcgtcgagagcgagcttaaggcaagcgaactcaagaacgtgctcgacgttatcatgaacgcttttcattggtgctccgttttcatgaccgaggagctcgttgacaaagacaacaatttttacgccgaactcgaggagatctacgacgagatctaccccgtcatctccctctacaacttggtgagaaactacgtcacccagaagccctacagcacaaagaagatcaagctcaacttcggcatcccaaccctcgccgacggctggtcaaaaagtaaggagtactccaacaacgccatcatactcatgagggacaacctctactatctcggtatcttcaacgctaagaacaaaccagacaagaaaatcatcgaggggaacacctccgaaaacaagggggattacaagaagatgatctataacctcctcccaggcccaaacaagatgatccccaaggtcttcctcagctccaagaccggagttgagacatacaagccctcagcctatatcctcgagggttacaagcagaacaaacatatcaagagcagcaaagatttcgatatcaccttctgccacgacctcatcgactattttaagaactgcatcgccatacatcccgagtggaagaacttcggttttgacttttccgacacctcaacttacgaggacatctccggcttctacagggaggtcgagcttcagggatataagatcgactggacttacatctccgaaaaggacatcgacttgctccaggagaagggacagctctatttgttccagatctacaacaaggactttagcaagaagagcaccggtaatgacaatctccataccatgtatcttaagaacctcttttccgaggagaacctcaaagacatcgtgctcaaattgaacggcgaggccgagatcttcttcagaaagagcagcatcaagaatcccatcatccacaagaagggttccatcttggttaataggacatatgaggccgaggagaaggaccagtttgggaacattcagatcgttaggaagaacatcccagagaacatctaccaggaactctacaaatacttcaacgacaaatccgacaaggagttgagcgacgaggctgccaaacttaagaacgttgtcggccaccatgaagccgccaccaatatcgtcaaggactataggtacacctacgataagtactttctccacatgcccatcaccattaatttcaaggccaataagaccggctttatcaacgacaggattttgcagtacatcgcaaaggagaaggacctccacgtgataggcatcgacaggggggagaggaacctcatctacgtttcagtcatcgatacctgcggcaacattgtcgagcagaaatcattcaacatcgtgaacgggtacgactaccagatcaaactcaagcagcaggagggggccaggcaaattgccaggaaggagtggaaggagattggcaagataaaggagatcaaggaggggtacctctcccttgtgatccacgaaattagtaaaatggtgattaaatataatgccatcatagccatggaagaccttagctatgggttcaagaagggaaggttcaaggtcgagaggcaggtctaccagaagttcgagaccatgttgatcaataagctcaactatctcgtctttaaagacatcagcatcaccgagaatgggggtctccttaagggctatcagctcacctacatccccgacaagctcaagaatgttgggcaccagtgcggctgcatcttctacgtccccgccgcctacacttcaaagatcgaccccacaaccgggttcgttaacatcttcaagttcaaggatctcaccgtggacgcaaagagggagttcatcaagaagttcgatagcatcaggtacgactccgagaaaaacctcttctgcttcacttttgactataacaattttatcactcagaacaccgtcatgtcaaagtcatcatggagcgtgtacacttatggagttaggatcaaaagaaggtttgttaatggcaggttctcaaacgagagcgacactatcgacatcacaaaagatatggagaagaccctcgaaatgactgacattaattggagggacggccacgacctcaggcaagacatcattgactacgagatcgtccagcacatcttcgaaatcttcagactcaccgttcagatgagaaactcactcagcgagcttgaagacagagattacgacaggctcatctcccccgtgctcaacgagaacaatatcttctacgactctgccaaagccggcgacgccttgcccaaggatgcagatgccaacggcgcttactgtatcgccctcaagggcctctacgagatcaagcagatcacagagaactggaaggaggacgggaagttctccagggataagcttaagatcagcaacaaggactggttcgactttatccaaaacaagaggtatctc

SEQ ID NO: 92 - DNA, 3789 bp, Artificial
  synthetic
atgaacaacggcaccaacaactttcagaacttcatagggattagttcacttcaaaaaaccctcaggaatgccctcatacccactgaaacaacccagcagttcattgttaagaacggcattatcaaagaggatgagctcaggggagagaacagacagatacttaaagacattatggacgactactacagaggcttcattagtgaaactctctcctccatcgatgacatcgactggacttccctctttgagaagatggaaatccagctcaagaacggggataacaaagacaccctcatcaaggagcagaccgagtataggaaggccatccacaaaaagttcgcaaatgacgacaggttcaagaacatgttctcagccaagcttatctccgatatcctcccagagttcgttatccacaacaacaactactccgccagcgaaaaggaggaaaagacccaggttatcaagctcttctctaggttcgctacatcctttaaggactatttcaagaacagggctaactgcttctccgccgacgacatctcatcctccagttgccataggatcgttaacgacaatgccgagatcttcttctccaatgccttggtctacaggaggatcgtgaagtctctctccaacgacgacattaacaagatcagcggagacatgaaggattcactcaaggagatgagcctcgaggagatctactcctatgagaagtatggcgaattcatcacccaggaggggatctccttctacaacgatatctgtggcaaagtcaacagcttcatgaacttgtactgccaaaagaataaggagaataaaaacctctataagctccagaaattgcacaagcagatcctctgcatcgccgacaccagctacgaagtgccctacaagtttgagtccgacgaggaggtctaccagtccgtgaacggatttctcgacaacatctccagcaaacacatcgttgagaggttgagaaaaatcggtgataattacaacggttacaacctcgacaagatctacatcgtctccaagttctacgagagtgtgtcccagaagacctacagggactgggagaccatcaacaccgccctcgaaatacattacaacaacatactccctggcaacgggaagtctaaggccgacaaggtcaagaaggccgtgaaaaacgacttgcagaagagcataaccgagattaacgagctcgtctctaactacaagctctgttccgacgacaacatcaaagccgagacctacatacacgagatatctcacatcctcaacaactttgaggcccaggagctcaaatacaatcccgaaatccacctcgttgagagcgagctcaaagccagtgagctcaagaacgtcctcgacgttatcatgaacgccttccattggtgcagcgttttcatgaccgaggagctcgtggacaaggacaacaacttctacgccgagctcgaggagatctatgacgaaatctaccccgtcatctccctctacaacctcgtcaggaactacgtcacccaaaagccctacagcaccaagaaaatcaaactcaattttggcatccccactctcgctgacggctggagcaagtccaaggagtacagcaacaacgctattatcctcatgagagataacctctattacctcggcatctttaacgccaaaaacaagcccgacaagaagatcatagagggcaacacctccgagaataagggagactataagaagatgatatacaacctccttcccggccccaacaaaatgatccccaaggtcttcctctccagcaagaccggcgttgagacctacaagccctccgcctatatcctcgagggatacaagcagaataagcacattaagagtagcaaagatttcgacattactttctgccatgatctcatcgactactttaaaaactgcatcgccatccacccagagtggaagaactttggcttcgacttcagtgacaccagtacctacgaggacatctccggattctatagggaggtggagctccagggatacaaaatcgactggacctacataagcgagaaggacatcgacttgttgcaggagaagggccagctctacctctttcaaatctacaacaaggacttcagcaagaagtccacaggcaacgacaacctccataccatgtatctcaagaatctcttctccgaggaaaacctcaaagatatcgtgctcaagctcaacggggaagcagagatcttcttcaggaaaagcagcatcaagaaccccataatccacaagaaaggatccatcctcgtcaacaggacctacgaagccgaggaaaaggatcagttcgggaacattcagatcgtcagaaagaacatccccgaaaacatctaccaggaactttacaagtacttcaatgacaaaagcgacaaggaactcagcgacgaggccgctaagctcaagaacgtcgtcgggcaccatgaggcagcaaccaatatcgtcaaggactacaggtacacctacgacaagtatttcttgcacatgcccatcaccatcaactttaaggccaacaaaaccggctttattaacgacaggatcttgcagtacatagctaaagagaaggatctccacgtcatcggaatagacagaggggagaggaatctcatttacgtgtctgtcatcgacacatgcggcaacatcgtcgagcagaagtccttcaacatcgtcaacggttacgattatcagatcaaattgaaacaacaggagggcgccagacagattgccaggaaggaatggaaggagatcggaaaaattaaagagatcaaagaggggtacctcagcctcgtgatccacgagatcagtaagatggttatcaagtacaatgccatcatcgcaatggaagatctctcctacggcttcaaaaaggggaggttcaaagtcgagaggcaggtttatcaaaagttcgagaccatgctcatcaacaaactcaactacctcgtcttcaaagacatctccatcacagaaaatggtggcctcctcaaaggataccaactcacctacatccccgacaaactcaagaacgtgggtcaccaatgcgggtgcatattttacgtgcctgctgcttacaccagcaagatagacccaaccaccgggttcgttaatatttttaagttcaaggacctcaccgtggatgccaagagagaattcatcaaaaagttcgactccatcaggtatgacagcgagaagaaccttttctgctttaccttcgactataataacttcatcacccagaacacagtgatgtctaagtccagctggagcgtctacacctacggggtcagaatcaagaggaggtttgtcaacggcaggttcagcaacgagtccgataccatcgacatcaccaaggacatggagaagaccctcgaaatgaccgatatcaactggagagacggacacgacctcagacaggatataatcgattacgagatcgttcagcacatcttcgaaatcttcaggctcaccgtccagatgaggaactccctctccgagctcgaggacagggactacgacaggcttatcagccccgtgcttaatgaaaacaacattttctacgacagcgccaaggccggtgacgcccttcccaaggacgccgacgccaacggcgcctactgtatcgcactcaaaggtctctacgagatcaagcagatcaccgagaactggaaggaggacgggaagtttagcagggataaattgaagatcagcaacaaagactggtttgactttatccaaaataagaggtacctc

SEQ ID NO: 93 - DNA, 3789 bp, Artificial
  synthetic
atgaacaacggaaccaacaactttcagaatttcataggcatctcctccctccagaagaccctcaggaacgccctcatccccaccgagaccacccagcaattcattgtgaaaaacgggatcatcaaggaggatgagctcagaggcgagaacaggcagatccttaaggatatcatggacgactactatagggggttcatatccgagaccctctcctccatcgacgacatcgactggaccagcctcttcgagaagatggagatacagctcaaaaacggcgacaacaaagataccctcatcaaagagcagaccgagtacaggaaggctatccataaaaaattcgccaacgacgacaggttcaagaatatgttctccgcaaaactcatcagcgatatcctccccgagtttgtgatccacaacaacaattactcagcctccgagaaggaggaaaagactcaagtgataaagctcttctctagattcgccacctccttcaaggactatttcaaaaatagggccaactgtttctccgccgacgatatcagctctagcagctgccacaggatcgtcaacgacaacgctgagatcttcttttccaacgccctcgtctacaggaggatcgtgaagagcctcagcaacgacgacatcaacaagatcagtggggatatgaaggacagcctcaaggaaatgagcctcgaggaaatctatagctacgagaagtacggggagttcatcacccaggagggaatcagcttctacaatgatatctgcgggaaggttaattccttcatgaacttgtactgccagaagaacaaggagaataagaatctttacaagctccagaagcttcacaagcaaatcctctgtatcgccgatacttcctacgaggtcccctataaattcgagagcgacgaggaggtgtatcaatccgtgaatgggtttctcgataatatcagttccaaacatatcgtcgagaggctcaggaaaataggggacaactacaacgggtataatttggacaaaatatacatcgtgagcaagttttatgagtcagtcagccagaagacttatagggactgggagaccatcaacacagccctcgaaatccactacaataacatcctccccggcaacggcaagtcaaaggcagataaggtgaaaaaagccgtgaagaacgacctccaaaaaagcatcaccgagatcaacgagttggtctcaaactacaagctctgcagcgacgacaatatcaaagccgagacctatattcatgagatttcccacatcctcaacaacttcgaggcccaggagctcaagtacaaccccgagatccacctcgtcgagagcgagctcaaagcttcagaactcaagaacgttcttgatgttatcatgaacgcctttcactggtgttcagtcttcatgacagaagagctcgtggacaaggacaacaacttctacgcagagctcgaagagatctatgatgagatctaccccgtcatctcattgtacaatctcgtcaggaactatgttacccagaagccatactccaccaagaagattaagttgaactttggcattcctaccctcgccgacggttggtccaaatcaaaggagtactctaacaacgccatcatcctcatgagggacaacctctactatctcggaatcttcaacgccaagaataagcccgacaagaagatcatcgaaggcaacacaagcgaaaataagggggactataagaagatgatctacaacctcctccccgggcccaacaaaatgatccctaaggtcttccttagcagcaagaccggagttgagacctacaaaccatccgcctacatcctcgagggctacaagcaaaacaaacacatcaagtccagcaaggactttgatatcacattctgccatgacctcatagactactttaagaactgtatcgccatccatcccgagtggaagaacttcggtttcgacttcagcgacacctccacatatgaagatatctctggtttctacagagaggtcgaactccagggctacaaaatcgattggacctatatctccgaaaaggatatagacctcctccaggagaaggggcagctctacctttttcagatctacaataaggacttctccaagaagagcaccggtaatgacaatctccatactatgtacttgaagaacctcttctcagaggagaacttgaaagacatcgttctcaagctcaacggcgaggccgagatattcttcagaaagtcttccattaagaatcccatcatccacaagaaagggagcatcctcgtgaacaggacctacgaggccgaggagaaagaccagttcgggaacatccagatcgtcagaaagaacatccctgagaacatctaccaagagctctataagtacttcaacgataaatccgacaaagagctctctgacgaagccgccaagttgaagaacgtcgtcgggcaccacgaagccgctaccaacatcgtcaaagactacagatatacctatgacaagtacttcctccacatgcctatcaccataaactttaaggccaataagaccggattcatcaacgacaggatcctccaatacatcgccaaggaaaaggacctccatgttatcggcatagatagaggagaaaggaatctcatctatgtgtccgtcatcgacacctgcggaaacattgttgagcagaaatcctttaacatcgttaacgggtatgactaccagattaagctcaagcaacaggagggcgccaggcagatagcaaggaaggagtggaaggagatcgggaagataaaggagatcaaagagggatacctcagccttgtcatccacgagatcagcaagatggttatcaagtacaacgccataatcgccatggaagacctttcatacgggttcaagaagggcaggttcaaggtggagaggcaggtgtaccaaaagttcgagaccatgctcatcaacaagctcaactacctcgttttcaaagatatcagcatcaccgaaaacggcggtcttcttaagggttaccagctcacctatatccccgacaagttgaagaatgttggccaccaatgtgggtgtatcttctacgtccccgccgcctacaccagcaaaatagaccccacaaccgggttcgtgaatattttcaaattcaaggacctcacagtcgacgccaaaagagaattcataaagaagttcgactccatcaggtacgattccgaaaagaacctcttttgcttcacctttgactacaacaactttatcacccaaaacaccgtgatgtccaaatccagctggtctgtttatacctacggcgttaggatcaagagaaggttcgtcaatgggagattctctaacgagtccgacaccattgacatcaccaaggatatggagaaaaccctcgagatgaccgatattaactggagggacggccacgacctcagacaggacatcatcgactacgagatcgtccagcacatcttcgaaatcttcagactcaccgttcagatgaggaactctctctccgagctcgaggacagggactacgacaggctcatctccccagtcctcaacgagaacaacatattttatgactccgccaaggctggtgacgcccttcccaaggatgccgacgccaacggggcttattgcatcgctctcaagggcctctatgaaataaagcagatcaccgagaactggaaggaggacggtaagttctctagggacaagctcaaaatcagcaataaagactggttcgacttcatccagaacaagaggtacctc

SEQ ID NO: 94 - DNA, 3789 bp, Artificial
  synthetic
atgaacaacgggaccaataacttccaaaatttcatcggtattagcagtttgcaaaaaaccttgaggaacgccctcatacccaccgaaacaacccagcagttcatcgtgaagaacggcataatcaaggaagacgaactcagaggcgaaaacaggcaaatcctcaaggacatcatggatgactactacaggggcttcatttccgagaccctctcctccatcgacgacatcgactggacctcactctttgagaagatggagatccagctcaagaatggcgataacaaggacaccttgataaaggagcagaccgaatacaggaaggctatccataagaagtttgccaacgacgacaggtttaagaacatgtttagcgctaagctcatcagcgacattctccccgagttcgtcatccataacaacaattactccgcctccgagaaggaggagaaaacccaggtcatcaagctcttctccaggttcgccaccagcttcaaggactatttcaagaacagagccaactgttttagcgccgatgacatctcctcctccagctgccataggatcgtcaacgataatgccgagatctttttcagcaacgccctcgtttacaggagaatcgtgaagagcctttccaatgacgacataaataagatcagcggcgacatgaaggacagccttaaggaaatgagcctcgaggagatctacagctatgaaaagtacggcgaatttatcacccaggagggaatcagtttctacaacgatatctgcggcaaagttaacagcttcatgaacctctactgccagaagaacaaggagaacaagaacctctacaaactccagaagctccacaaacaaattttgtgcatcgctgacaccagctacgaggttccttacaagttcgagtccgatgaggaggtctaccaaagcgtgaatggattcctcgacaacataagtagcaaacacatcgtcgagaggttgaggaagatcggcgacaactacaatggatacaacctcgacaagatatacatcgtctcaaagttctacgagagcgtctctcagaagacctacagggattgggagaccatcaacaccgcccttgagatccactacaacaacatactccccggcaacggcaagtccaaagccgataaggttaagaaggctgtgaagaacgacctccagaagtccattaccgagatcaacgaactcgtgtccaactacaagttgtgcagcgatgacaatatcaaggccgaaacatacatccacgaaatctcccatatactcaacaacttcgaggcccaggagctcaaatataaccccgagatccacctcgtcgaatccgagcttaaagccagcgagctcaagaacgtgctcgatgtcattatgaacgccttccactggtgctccgttttcatgaccgaagagctcgtcgataaggacaacaacttctacgccgagctcgaagagatctacgacgagatttaccccgttatctcactttacaacctcgtcaggaactacgtgacccagaaaccttacagtacaaaaaagatcaagttgaattttgggatccccacactcgccgacgggtggagcaagtccaaagagtactccaacaacgccatcatcctcatgagggacaacctttattatctcggcatcttcaacgccaagaacaagcccgacaaaaagatcatcgaggggaacacatccgaaaacaagggggattacaagaaaatgatctataacctcctccccggccccaataaaatgatccccaaggtttttctctcaagcaaaaccggcgtcgaaacctataagcccagcgcctacatcctcgagggctacaagcagaacaagcacataaagtcttccaaggatttcgacataaccttctgtcacgacctcatagactatttcaaaaactgtatcgccatccaccctgagtggaaaaatttcggctttgacttctccgacacctccacttacgaggacatctccgggttttacagggaggtcgagctccagggctacaagatcgactggacctatattagtgaaaaggacatagacctcttgcaggagaaggggcaactctatctcttccagatctacaacaaggactttagcaagaagagcacagggaacgacaacctccacaccatgtacctcaagaacctcttcagtgaggagaatctcaaggacatcgttcttaaactcaatggggaggccgagatcttctttaggaaaagttccattaagaaccccatcatccacaagaagggctccatattggtcaacaggacctacgaggccgaagagaaggaccaattcgggaacattcagatcgttaggaagaacatccccgagaacatctaccaggagctctacaagtattttaacgacaagagtgacaaagagctctccgatgaggccgccaaactcaaaaacgtggtcggtcaccacgaggccgccactaatatcgtgaaggattacaggtacacatacgataaatactttctccacatgcccattaccatcaatttcaaggctaacaagaccggcttcatcaacgacaggatactccagtacatcgcaaaagagaaagacctccacgtcatcggcatcgacagaggggaaaggaaccttatctacgtcagcgttatagacacctgcggcaacatcgttgagcagaagagcttcaacattgtcaatggctatgactatcagataaagctcaaacagcaggagggggccaggcaaatcgccaggaaggagtggaaggagatcggcaagatcaaagaaatcaaggagggctacctctccctcgttatccacgagatctccaaaatggtcatcaagtacaatgccatcatcgcaatggaggacctcagctacggcttcaagaaggggaggttcaaggttgaaaggcaggtgtaccagaaatttgagacaatgctcattaacaagttgaactatctcgtttttaaggacatcagcattaccgagaacggggggctcctcaaggggtatcagttgacttacatacctgacaaactcaaaaatgtgggccaccaatgcggctgcatcttctacgttccagccgcctacacctccaaaatcgatccaaccaccggatttgtcaatatcttcaagtttaaggacctcacagttgacgccaagagggagtttatcaagaagttcgattccatcaggtacgatagtgagaagaacctcttctgcttcacctttgactataataactttatcacacaaaataccgttatgtccaaaagctcctggtccgtgtacacctatggcgttaggattaaaaggaggttcgtgaatggcagattctcaaacgagagtgacaccatcgatataactaaagatatggaaaagacactcgaaatgaccgatatcaactggagggacgggcatgatctcaggcaggacataatcgactacgaaatcgtccaacatatcttcgagatcttcaggctcaccgttcagatgaggaacagcctcagtgagctcgaggacagggactatgacaggctcatcagccccgttcttaacgagaacaatatcttttacgactccgccaaggctggagacgccttgcccaaggacgccgacgccaacggcgcctactgcatcgccctcaaggggctctacgagatcaaacagattaccgagaactggaaggaggacggcaagttctctagggacaagctcaagatctccaataaagactggttcgacttcatccagaacaagaggtacttg

SEQ ID NO: 95 - DNA, 3789 bp, Artificial
  synthetic
atgaacaacgggaccaacaacttccagaacttcatcggaatcagctccctccagaagaccctcaggaacgcactcatccctaccgaaaccactcagcagttcatcgttaaaaatggcatcatcaaagaggatgagcttagaggcgaaaataggcagattcttaaggacatcatggacgactattacaggggtttcatttccgaaactctctccagtatcgacgacatcgattggacctccctcttcgaaaagatggaaatccagctcaagaatggtgacaacaaagacaccctcatcaaggaacagaccgagtacaggaaggctatccacaagaagtttgccaacgatgacagattcaagaatatgttcagtgccaagttgatcagcgacatcctccccgagttcgtcatccacaacaacaattactctgcttccgagaaagaggagaagacccaggtcataaagctcttctcaaggttcgctacatccttcaaggactatttcaaaaacagggctaactgctttagcgccgacgacatcagcagctcttcctgccacaggatcgtgaatgacaatgccgaaatcttcttcagcaacgccctcgtctacaggaggatagtcaagtccctcagcaacgacgacatcaacaagatcagcggcgacatgaaggacagcttgaaggagatgtctctcgaggagatctacagctacgagaagtacggggagtttatcacccaggaagggatttccttttacaacgacatttgcgggaaggttaacagctttatgaatctctactgccagaaaaacaaggagaacaagaacctttataagttgcaaaaacttcacaagcagatcctctgcatcgcagatacctcctatgaggttccctataagttcgagagcgacgaagaggtctaccagtccgtcaacggcttcctcgataacatcagcagcaagcacatagttgagagactcaggaagatcggcgataattacaacggctacaatctcgacaagatttatatcgtgagcaagttttatgaatccgtgagccaaaaaacctacagggactgggaaaccattaatactgctctcgagatccactataacaatatcctcccagggaacggtaagtcaaaggccgacaaggtgaagaaggccgtcaagaacgatctccagaagagcatcactgagatcaatgagctcgtctccaactataagctctgctccgacgacaacatcaaggccgaaacctacatccacgagatctcccatatcctcaacaatttcgaggcccaagagctcaagtacaaccccgagatccacttggtggagtccgaactcaaggccagtgagctcaaaaacgtgctcgacgttatcatgaacgcatttcactggtgctccgtgttcatgaccgaagagctcgtggacaaagacaacaacttctatgccgagctcgaggagatctacgacgagatctatcccgtgatctccctctacaatctcgtgaggaactacgtcacccagaaaccttacagtaccaaaaaaattaagctcaacttcggcatccccaccctcgccgatggttggagcaagtccaaggagtactccaataacgctatcatcctcatgagggacaatctctactacctcgggatcttcaacgccaagaataagcccgacaagaaaatcatcgagggaaacacatccgagaacaagggcgattacaagaaaatgatatataacctcctccccggacctaacaagatgattcccaaggttttcctcagcagcaagaccggggtggagacctataaacccagtgcctacatcctcgagggctataagcaaaataagcacattaagtccagcaaggacttcgacatcaccttctgtcacgacctcatcgactacttcaagaattgcatcgccatccaccccgagtggaaaaatttcggtttcgacttcagcgacacctctacctacgaagacatctccgggttctacagagaggtcgagctccagggctacaagatcgactggacctacatcagcgagaaggacatcgacctcctccaagagaagggacagctctacctcttccaaatatacaacaaggacttctctaaaaagagcaccggcaacgacaacctccataccatgtacttgaaaaacctcttctcagaggagaacctcaaagacatcgtgcttaaacttaacggcgaagccgaaatcttcttcagaaagagctccatcaagaaccccattatccacaagaagggatcaatcctcgtcaacaggacctacgaggccgaggagaaggaccaattcggcaatatccaaatcgtcaggaagaacatccccgaaaacatctaccaggaactctataaatatttcaatgacaagtccgacaaggagctctcagatgaggccgccaaattgaagaatgtcgtgggccaccatgaggccgcaactaacattgttaaagactataggtacacctatgataagtacttcctccatatgcccattaccatcaattttaaagccaacaaaaccggtttcatcaatgataggattctccagtacatcgctaaggagaaggacctccacgtcataggtatcgacaggggcgagaggaaccttatctacgtttccgtcatcgacacctgcggcaatattgtggagcagaagagttttaatatcgtcaatggctacgactaccagatcaaacttaagcagcaagagggcgccaggcagattgctagaaaggaatggaaggaaatcggcaagatcaaggagattaaggaggggtacttgagcctcgtcattcacgagatcagcaagatggtcataaagtacaacgccatcatagccatggaagatctcagttatgggttcaagaaggggaggttcaaggttgagaggcaggtttaccagaagttcgagacaatgctcatcaacaagctcaactacctcgtctttaaggacatctccattaccgaaaacggtggcctcctcaagggttaccaactcacctacatccccgataagcttaagaacgtgggccaccagtgcggctgtatcttctatgttcccgccgcctacaccagtaagatcgacccaacaaccggcttcgtgaacatcttcaaattcaaggacctcaccgtcgacgccaagagagagttcatcaagaagttcgactccatcagatacgactccgagaagaacctcttctgcttcaccttcgactacaacaatttcatcacccaaaacaccgtcatgagcaagagctcctggtcagtgtacacttacggggttaggatcaagaggaggttcgtgaacggcaggttcagcaacgagagcgacaccatcgacatcaccaaggatatggagaagaccctcgagatgaccgatatcaattggagggacggtcatgacctcaggcaggacattatcgactacgagatcgtccagcacatcttcgaaatctttaggctcaccgtgcagatgagaaactccctctccgagctcgaggacagggactacgacaggctcatctctcccgtgctcaacgagaacaacatattctacgattccgccaaggccggggatgccctccccaaggacgccgacgccaacggagcatattgtatagccctcaagggtctctacgagatcaagcagatcacagaaaactggaaagaggacggcaagttctccagggacaagctcaagataagcaacaaggactggttcgacttcatacaaaacaagaggtacctc

SEQ ID NO: 96 - DNA, 3789 bp, Artificial
  synthetic
atgaacaacgggactaacaacttccagaatttcatcgggataagctccctccagaaaactctcagaaacgccctcatacccactgagaccacccaacaattcatcgttaaaaacggaataatcaaagaggacgagttgaggggcgagaacaggcaaatcctcaaggacataatggacgactattacaggggcttcatctccgagaccctcagctcaatagatgatatagactggacctctctcttcgaaaaaatggagatccaattgaagaacggtgacaacaaagacaccctcatcaaggagcagaccgagtacaggaaggcaattcacaaaaagtttgccaacgacgatagattcaaaaacatgttttcagccaagttgatctccgacatcctccctgagtttgtgatccacaacaacaactacagcgcctctgaaaaggaagagaagacccaggtgatcaagcttttctcaaggtttgccaccagctttaaggattacttcaagaacagggctaactgtttctcagccgacgacatctccagctcatcttgccacaggatcgtcaatgacaacgccgagatatttttcagcaacgctctcgtgtatagaagaatcgtgaagtccctctctaacgatgacatcaacaagatcagcggtgacatgaaggacagtctcaaagagatgtcactcgaagagatttacagttacgagaaatatggcgaattcatcacccaggagggcatcagcttctacaatgatatctgcgggaaggtcaacagcttcatgaatctctactgccagaagaacaaggagaataagaacctctacaaacttcaaaagctccacaagcagatcctctgcattgcagacacctcctacgaagtgccctacaaatttgagagtgatgaggaggtctaccaatcagttaatggcttcctcgataacatcagttccaagcacatcgtcgagaggctcaggaaaatcggtgataattacaatggttataacctcgataaaatatacatcgtgagcaagttctacgaatccgttagccagaagacctacagggactgggagaccatcaacaccgccctcgaaatccactacaacaacatcctccctggaaacggcaagtccaaggctgataaggtcaagaaggccgttaagaacgacctccaaaagagcatcacagaaatcaatgagctcgtgagtaactataagttgtgttccgacgataacatcaaggccgaaacctacatccacgagatctctcacatcctcaacaacttcgaggctcaggagctcaagtacaaccccgagattcacctcgtcgagagcgagctcaaggcatcagagctcaagaacgtcttggacgtgatcatgaacgccttccactggtgtagtgtgttcatgacagaggagctcgtcgacaaagacaacaatttctacgcagagttggaggagatctacgacgagatatacccagtgatctctctctataacctcgttaggaattacgtgacgcagaagccctactccaccaagaaaatcaaactcaacttcggcatccccaccctcgctgacgggtggagtaagtccaaggagtactccaacaacgccattattctcatgagggacaatctctactatctcgggatcttcaacgccaagaataaacccgacaagaaaatcatcgagggtaacacctccgagaacaagggggactacaaaaagatgatctataacctcctccctggccctaacaagatgatccccaaggtgttcctcagcagcaagaccggcgtggagacctacaagcccagcgcctacatcctcgagggatataagcagaataagcatatcaaaagcagcaaggacttcgacatcaccttctgccatgacctcatcgattacttcaagaattgcattgccatccatccagaatggaagaatttcggctttgactttagcgacacctccacctacgaggacatctctggcttttacagggaggtggagctccagggatacaagatcgattggacctacattagcgaaaaggacatcgatctcctgcaggagaaggggcagctctatcttttccagatttacaacaaggacttcagcaaaaagagcaccggcaacgacaacttgcataccatgtacctcaagaacctcttcagcgaggagaatctcaaggatatcgtgctcaaacttaacggcgaggccgaaatttttttcaggaaaagctccatcaagaaccccataatccacaagaaggggagcatccttgtgaatagaacctacgaggccgaggaaaaggaccaattcggcaacatacaaatcgtcaggaagaacatccccgagaacatctatcaggagctctataagtacttcaacgacaagtctgacaaagagctcagcgatgaggccgccaaattgaaaaacgtcgtgggccaccatgaggcagccaccaacatcgtgaaggactacaggtacacctatgacaaatatttcctccacatgcccatcaccatcaactttaaggccaataagaccgggttcatcaacgacaggatattgcagtatatagctaaggagaaagacctccacgttataggcatagacagaggcgagaggaacctcatttacgtgtctgtcatagacacctgcgggaacattgtcgagcagaagagcttcaacatcgtgaacgggtacgactaccaaattaagctcaagcagcaagagggcgccaggcagatcgccaggaaggagtggaaggagatcggcaagatcaaggagataaaggaaggctacctttccctcgtcattcatgagatctccaaaatggtcatcaagtacaatgccataatcgccatggaggacctcagctatggcttcaaaaagggcagatttaaagtggaaagacaggtgtaccagaagttcgagacaatgctcatcaacaagctcaattacctcgtgtttaaggatataagtattaccgagaatggcggactcctcaaagggtaccagctcacctacatccccgataaactcaagaacgtggggcaccagtgcgggtgcatattctacgttcccgccgcctacactagcaagattgaccccaccaccgggtttgttaatatcttcaagtttaaggacctcaccgtcgacgccaagagagaattcatcaaaaagttcgattccatcagatatgacagcgagaagaatctcttttgcttcaccttcgactataataacttcatcactcagaacaccgttatgtccaagagcagttggagcgtgtacacatacggggtgaggatcaagaggaggttcgtcaacgggaggttctccaacgagagcgataccatagacattaccaaagacatggagaagaccctcgagatgaccgacatcaactggagggacggtcacgacctcaggcaggacattatcgattacgagatcgtgcaacacatcttcgagatctttaggctcaccgttcaaatgagaaacagcctcagcgagctcgaggacagggactacgacaggctcatcagccccgttctcaacgaaaacaacatcttttacgactccgccaaggccggggacgctctccccaaggatgccgacgccaatggcgcatactgcatcgccctcaaagggctctacgaaatcaaacaaatcaccgagaattggaaggaggacgggaaattctctagggacaagctcaagatctccaacaaagactggttcgatttcatccagaacaagaggtaccta

SEQ ID NO: 97 - protein, 986 aa, Unknown
  deltaproteobacterium
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

SEQ ID NO: 98 - DNA, 2958 bp, Artificial
  synthetic
atggagaagaggattaacaagattaggaagaaattatccgctgataacgcaaccaaaccagtttcccgaagcggcccaatgaagactctgctcgttagagtgatgacagacgatcttaagaaaagactcgagaagcgtagaaagaagccggaggttatgccccaggtgatttctaataacgcagcaaacaatcttcgaatgttgttggacgattatactaaaatgaaggaagccatccttcaggtgtactggcaggaatttaaagatgaccacgtgggtcttatgtgcaaattcgcgcagcccgcaagcaagaagattgaccagaataaactcaagccagagatggacgaaaagggcaatttgaccactgcagggttcgcttgttctcaatgtggacagccgttgttcgtttataagctcgaacaggtgagtgagaaaggaaaggcgtataccaattactttgggagatgtaatgtggctgagcatgagaagttaattcttctcgctcaattgaagcctgagaaagacagtgatgaggctgtgacatactctttgggtaaatttgggcaacgggcattagatttttattccatccacgtgactaaagaatcaacccacccagtgaagcctctagctcaaatcgctgggaacaggtacgcctcaggcccagtaggaaaagcgctgtcagacgcatgtatgggcactatcgcatccttcttgagtaagtatcaggatattatcatagagcaccagaaagtcgtgaagggtaatcagaagagattagaaagtctcagagaattagcgggtaaagagaatttagaatacccatcagttacattgccaccgcagccacatactaaggagggcgtggatgcctataacgaggtaatcgcaagggttcggatgtgggttaacctaaatttatggcaaaaacttaaactgagtagggacgatgctaagcccttactccgattgaaggggtttccatcttttcctgtggtagaacgccgcgagaatgaggtcgattggtggaatacaataaacgaggtaaagaagctgattgatgcaaagcgcgatatgggtcgagtgttctggtctggggtgacggccgagaagcgcaataccatattagagggttacaactatttgccaaacgaaaatgatcacaaaaaacgtgagggttccttggagaatcccaaaaagcctgccaagcgtcaattcggggatttgttgttgtatctagagaaaaaatatgcaggagactggggaaaagtcttcgacgaggcctgggaacggatcgacaaaaaaatagcagggcttacttcacatattgaaagggaagaagctagaaacgcggaggacgctcaatcaaaggcagtgcttaccgattggctcagagcaaaggcatcattcgttttagaacgattgaaggaaatggacgagaaggaattttacgcttgcgaaattcaattacaaaagtggtacggtgacctccgtggtaacccctttgctgtggaggcagagaacagggttgtagatatctctggattttctattggtagtgatggtcacagtattcagtataggaatttactagcatggaaataccttgagaacggcaagagagagttctacttactaatgaattacggcaagaaaggcaggattcgctttaccgatggaactgatattaaaaagagtggcaaatggcaagggcttctatatggagggggtaaggctaaagtgattgatttaacctttgatcctgacgacgaacaactaattattctgcctctagcgtttggaactcgccaaggaagagaatttatctggaacgacttgttgtccttagagaccggactcatcaagcttgcaaacggcagagtaatagaaaagacaatatataacaaaaagattgggagagatgaaccggctctcttcgttgcattaacattcgagaggcgggaggtggtggatccatctaacataaagccggtaaacttaattggcgtggatcgtggtgaaaatattccagctgtcatcgcattgacagacccagagggttgcccactgcctgaattcaaagactcttcaggtggacccacagatattctccgaataggggagggttacaaggagaagcagcgtgctattcaagctgctaaagaggttgagcagaggagggccgggggttactcccgtaaattcgcctctaaatctcgaaacttggccgacgatatggttcggaattctgctagagatctattttaccatgctgttactcacgatgcagtcttggtgttcgagaatttgtccaggggtttcggtagacaaggaaagagaacatttatgaccgaaagacaatatacgaagatggaagactggctcacagctaagttggcatatgagggactgacatccaaaacttacctatcgaagacccttgcgcaatatacgtccaagacttgctctaactgcggatttactattacgacggctgactatgatgggatgcttgtgagattaaaaaagacctcggatggttgggccacaacattgaacaataaagagttgaaagctgagggccaaataacttactataataggtacaaacgccaaacagtggaaaaggagttgtccgcagagttagacaggctttctgaagaatcggggaacaatgacatttcgaagtggactaaagggcgtcgtgacgaggcattattcttgcttaagaaaagattctcccatagaccagtgcaggagcagtttgtgtgcctggattgcggacacgaggttcacgcagatgagcaagccgcattgaacattgccaggtcgtggctttttctgaactctaatagcaccgaattcaagtcatataagtcggggaaacaaccctttgtaggggcatggcaagctttttataagagaaggcttaaggaggtatggaagcccaatgca

SEQ ID NO: 99 - DNA, 2958 bp, Artificial
  synthetic
atggagaagagaatcaataagatcaggaagaagctctccgccgacaatgccaccaagcctgtgtccagatcaggccccatgaaaaccctcctcgtgagggtgatgaccgacgaccttaagaagagactcgagaagagaaggaagaagcccgaagtgatgccccaggtcatttcaaacaacgccgccaacaatctcaggatgctcctcgacgactacaccaagatgaaggaagccatcctccaggtctactggcaggagttcaaggacgaccacgtggggttgatgtgcaagttcgcccagcccgcttccaaaaaaatcgaccaaaacaagctcaaacctgagatggacgagaagggcaacctcacaaccgccggtttcgcctgctcccagtgcggacagccactcttcgtttacaagttggagcaggttagcgagaagggcaaggcttacaccaactacttcggcaggtgcaatgtcgccgagcatgaaaagcttatccttctcgcccaactcaagccagagaaagacagcgacgaagcagttacttactctctcggtaagtttggtcaaagggccctcgatttttacagcatccatgtcaccaaggagtccactcatcccgtgaagcctctcgcccaaatcgccgggaacaggtatgccagcgggcccgtcgggaaggcactcagcgatgcctgcatgggcacaatcgccagcttcctcagcaagtaccaggatatcatcatcgaacaccagaaggtcgtgaaaggcaaccaaaaaaggcttgagagcctcagggagctcgccggcaaggagaatttggaatatcccagcgtgactctccccccccagccacacaccaaggagggggtcgacgcttacaatgaggttatagccagggtcagaatgtgggttaacctcaacctctggcagaaactcaaactcagtagggacgacgccaaacccctccttaggctcaaagggttccccagctttccagtcgtggaaagaagggagaacgaggttgactggtggaatacaatcaacgaggtgaagaaactcatcgacgccaagagggatatgggcagggtcttctggagcggggtcaccgccgaaaagagaaacaccatcctcgaagggtataactaccttcccaatgagaacgatcacaagaagagagagggcagcctcgaaaaccccaagaagccagccaagaggcaattcggggatctcctcttgtacctcgagaagaagtacgctggagactgggggaaggttttcgacgaagcctgggagaggatcgacaaaaaaattgccgggcttacctcccatattgagagggaagaggctagaaacgccgaggacgcacagtctaaggccgtcctcaccgactggcttagggccaaagcctctttcgtcctcgagaggctcaaggagatggacgagaaggagttctacgcctgcgagatccaactccaaaagtggtacggagacctcaggggtaaccccttcgccgtggaggccgaaaatagggtcgtggatatctccggattcagcataggtagcgacggtcactccatccagtatagaaacttgttggcctggaagtacttggagaacggtaagagggagttctaccttctcatgaactacggcaagaagggcaggatcaggtttaccgatgggaccgatatcaagaagtccggaaagtggcaggggctcctctacggcggaggtaaggccaaggttatcgatctcaccttcgacccagacgacgagcaactcatcatcctcccccttgcctttgggacaaggcagggaagagagttcatctggaatgacctcctttccctcgagaccggccttatcaagctcgccaacggtagggtcatcgagaagaccatctacaacaaaaagatcgggagggacgagcccgccttgttcgttgcactcacctttgagaggagggaagtggtcgaccctagcaacatcaagcctgtgaatcttatcggagtggacaggggggagaacatacccgccgtgatagctttgaccgaccccgagggttgtccccttcccgagttcaaggactcatcaggggggcctaccgacatcctcaggatcggggagggctacaaggagaagcagagggccatccaggccgccaaagaggttgagcagaggagagccggggggtacagcaggaaattcgccagcaaatccaggaacctcgccgacgacatggttaggaacagcgctagggatctcttctaccatgccgttactcacgacgccgtgctcgttttcgaaaacctctccagggggttcggtagacagggcaagagaactttcatgaccgaaaggcaatataccaagatggaggactggctcaccgccaaactcgcctacgaggggctcacttctaagacctacctcagcaagaccctcgcccagtatacctcaaagacttgctccaactgcgggtttacaattaccaccgctgattacgacggcatgctcgtcaggcttaaaaagaccagcgacgggtgggccaccaccctcaataacaaggagctcaaggccgagggccagataacctactacaacaggtacaaaaggcagaccgtcgaaaaagagttgtccgctgagctcgacaggctctccgaggagtccggcaacaacgacatcagcaagtggaccaagggaaggagagatgaggccctcttcttgctcaaaaaaaggttcagccacaggcccgtccaggagcagtttgtgtgcctcgactgcggccacgaggtgcacgccgatgaacaagccgccttgaatatagccaggagctggcttttcctcaactccaattcaaccgaattcaagagctacaaaagcgggaaacaacccttcgttggcgcatggcaggctttctacaagaggaggttgaaggaggtgtggaagcccaacgcc

SEQ ID NO: 100 - DNA, 2958 bp, Artificial
  synthetic
atggagaagaggattaacaagatcaggaagaagctctccgccgacaacgctaccaagcccgtttccaggtcaggtcccatgaaaaccctcctcgtgagagttatgaccgatgacctcaaaaagaggctcgaaaagaggaggaagaagcccgaggtgatgccccaggtgataagtaacaatgctgccaataatctcaggatgctcctcgacgactacaccaagatgaaggaagcaatcctccaggtttactggcaggaattcaaggacgaccacgtgggcctcatgtgcaagttcgcccagcccgcctccaagaagatcgaccaaaacaagctcaaaccagagatggacgagaagggcaacctcaccaccgcaggcttcgcctgcagccagtgcggccagccactcttcgtctacaagctcgaacaggtcagcgaaaaggggaaggcctataccaattacttcggtaggtgcaacgtcgccgagcacgagaagctcatccttctcgcccaactcaagcccgagaaggactccgacgaggccgtcacctacagcttggggaaattcgggcagagggccctcgatttctattcaatccacgttaccaaggagtccacccatcccgtgaagcctctcgcccaaatcgccggcaataggtacgcatccggccccgtcggaaaggccttgtccgacgcttgtatggggaccattgcaagcttcctcagcaaataccaggacatcatcatcgagcaccagaaggttgtcaaagggaatcagaagaggctcgagagcttgagggagcttgccggtaaggagaacttggaataccccagcgttacactccccccccagcctcacacaaaggagggggtcgacgcctataacgaggtcatcgccagagtcaggatgtgggtcaatcttaacctttggcagaagcttaaactctccagggacgacgccaaacccctcctcagactcaaggggtttcccagcttccccgtggttgaaagaagggagaacgaggtggactggtggaatacaatcaacgaggtcaagaagctcatagatgctaagagggatatggggagggtcttctggtccggagttaccgccgagaaaaggaacaccatcctcgagggttataactacctccccaacgaaaatgaccacaagaaaagggaaggaagcctcgagaaccctaagaagcccgccaagaggcaattcggggacctcctcctttacctcgagaaaaagtacgccggagactggggtaaggtttttgacgaagcctgggagaggatcgacaagaagatcgccggactcacctcccacatcgaaagggaggaggccaggaacgctgaggacgcacaatccaaggccgttctcaccgattggcttagggccaaggccagctttgtccttgagagacttaaggaaatggacgagaaggagttttacgcctgtgaaatccagttgcaaaagtggtacggtgatctcaggggcaaccctttcgcagtggaagccgaaaatagagtggtcgacatcagtggtttcagcattggctccgatggacattccattcaatacaggaatctcctcgcctggaagtacctcgagaacggtaagagggagttctacttgctcatgaactacggcaaaaaggggagaattaggttcaccgacggcactgacatcaagaaatcaggaaagtggcaggggttgctctatgggggtggaaaggcaaaagttattgacttgaccttcgaccccgatgacgaacaactcatcatcctccccctcgccttcgggacaaggcagggcagggagttcatctggaacgacctcctcagccttgagaccgggctcatcaagctcgccaacggcagagtgatcgagaagaccatctataacaagaagatcggcagagatgagcccgctctcttcgttgccctcactttcgagagaagggaggtggtcgacccctccaacataaaacccgtgaacctcatcggtgtggacagaggggagaatatccccgccgttatcgccctcaccgaccccgagggctgccccctccccgagttcaaggacagcagcggcggcccaactgatattctcaggatcggggaggggtataaggagaagcagagggccatccaagccgccaaggaggtggagcaaaggagggctggggggtatagcaggaaattcgcctcaaagtccaggaacctcgccgatgatatggtgaggaactcagctagggacctcttttaccacgccgtgacccacgacgctgttctcgtgttcgagaacctcagcagaggttttggtaggcaggggaaaagaacctttatgacagagaggcagtataccaagatggaggattggttgacagctaagctcgcctatgagggccttacttcaaagacctacctcagcaagaccctcgcccagtatacctcaaagacctgcagcaactgtgggttcaccattaccaccgccgactacgacgggatgctcgtcaggcttaagaagaccagcgacggttgggcaaccaccctcaacaacaaagagctcaaggccgaagggcagatcacctactacaacaggtataagaggcagaccgtcgaaaaagaattgagcgccgagctcgacagactctctgaggagagcggcaacaacgacattagcaagtggaccaaggggagaagagatgaggcccttttcctcctcaagaaaaggttcagccataggcccgtgcaggagcagttcgtttgcctcgactgtggtcatgaggtgcatgcagacgagcaggccgctctcaacatcgccaggtcctggctctttcttaatagcaactctaccgagttcaagagctacaagagcggcaagcaacccttcgtgggggcctggcaggccttttacaagaggaggttgaaggaggtttggaagcccaacgcc

SEQ ID NO: 101 - DNA, 2958 bp, Artificial
  synthetic
atggaaaagaggatcaataagataaggaagaaactctccgccgacaatgccaccaagcccgttagcaggtccggtcccatgaagaccctccttgtcagggttatgaccgatgatctcaagaaaaggctcgagaaaaggaggaagaagcccgaggttatgccccaggtcatctccaacaatgccgcaaacaacttgagaatgcttctcgacgactacaccaagatgaaggaggccatactccaagtgtactggcaggagttcaaggatgaccacgtgggcctcatgtgcaagttcgcccagcccgcctccaaaaagatcgaccaaaacaagctcaagcccgagatggacgagaaggggaacctcaccaccgccgggttcgcttgcagccagtgtggacagcccctcttcgtctataagctcgagcaagtctccgaaaagggcaaggcctacaccaactacttcggaagatgcaacgtcgctgaacacgagaagctcatcctcctcgcccagctcaaacccgaaaaggacagcgacgaggccgtcacctatagcttggggaagttcggccaaagggccctcgatttttactccatccacgtgaccaaggaaagcacccaccccgtcaaacccctcgcccagatcgccggcaacaggtacgcctcaggccccgttggcaaagccctcagcgacgcctgcatggggaccatcgcctccttcctctccaaatatcaggacatcataatcgaacaccaaaaggttgtgaaggggaaccagaagaggctcgaaagcctcagggagctcgccgggaaagagaacctcgagtacccctcagtgaccctccccccccagccccacacaaaggagggggtggatgcctataacgaagttatcgccagagtcaggatgtgggtcaacctcaacctctggcagaagctcaaactcagcagggacgatgccaagccactcctcagactcaagggtttcccctccttccccgtggttgagaggagggaaaacgaagtcgactggtggaacaccatcaacgaggtgaaaaagctcatcgacgccaagagggacatggggagagtcttctggtccggcgtgaccgccgagaagaggaacaccatcctcgaggggtataactacctccccaatgagaacgatcataaaaagagggaaggtagcctcgaaaatcctaagaagccagccaaaaggcagttcggcgaccttctcctttatctcgaaaaaaagtacgccggggactgggggaaagtgttcgacgaggcctgggagaggatcgacaagaaaatcgccggcctcactagccacattgaaagggaggaggccaggaacgccgaggacgcccagtcaaaggccgttctcaccgactggttgagggcaaaggcctcctttgtgctcgagaggctcaaggagatggacgagaaggagttctatgcctgcgagattcagctccagaagtggtacggagacctcaggggcaacccatttgccgtggaagccgagaacagggtcgtcgacatcagcggcttctccataggctccgacgggcactccatccagtacaggaatttgctcgcttggaagtacctcgagaacgggaagagagaattctacctcctcatgaactacggtaagaaagggaggatcaggttcaccgacgggaccgacattaagaagagcggtaaatggcagggcctcttgtacggtggggggaaggccaaggtgattgacctcacctttgaccccgacgacgagcagctcatcatcttgcccctcgccttcggcaccaggcaggggagggagttcatctggaacgatctcctcagccttgagaccggactcatcaagcttgccaatggaagggtcattgagaaaaccatatacaacaagaagatcgggagagatgaacccgccctctttgttgcactcaccttcgaaaggagggaggtcgttgacccctccaatataaagccagtgaacctcatcggggtcgacaggggggagaacatccccgcagtcatcgccctcaccgatcccgagggctgcccccttcccgagtttaaggacagctcaggcggccccaccgacatcctcaggatcggcgagggctacaaggagaagcagagggccatccaagctgccaaggaggttgagcagaggagggccggggggtatagtaggaagtttgccagcaagagcaggaatctcgccgacgacatggtcagaaactccgccagagacctcttctatcatgctgtgacccacgatgccgtcctcgtcttcgagaacctctccaggggtttcggcaggcaggggaaaaggacattcatgaccgagaggcagtacaccaagatggaggattggctcacagcaaagctcgcctatgagggccttaccagcaaaacttacctttctaagaccctcgctcaatacacttcaaaaacatgcagcaattgtgggttcactatcaccaccgccgattatgacgggatgttggtgagacttaagaagactagcgacggctgggccaccaccctcaacaacaaggagctcaaggccgaggggcagataacctactacaacaggtacaagaggcaaaccgttgaaaaggagctcagcgccgagctcgacaggctctcagaggagagcggcaacaacgacatcagcaagtggaccaagggcaggagggacgaggccctcttcctcctcaagaagaggttctcacataggccagtgcaagagcagttcgtgtgtctcgactgcggccacgaggtgcacgccgacgagcaggccgccctcaacatcgccaggtcttggctcttcctcaatagcaactcaaccgagttcaagagttataagtccggaaagcagccctttgtgggggcctggcaagccttctacaagaggagattgaaggaggtctggaagcccaacgcc

SEQ ID NO: 102 - DNA, 2958 bp, Artificial
  synthetic
atggagaaaaggatcaacaagatcagaaagaagctcagcgcagacaacgctactaagcccgtttctaggagcgggcccatgaagaccctcttggtcagggttatgaccgacgacctcaagaagaggcttgagaagaggaggaagaagcccgaggtcatgcctcaggtgatcagtaacaacgctgccaataatctcaggatgctcctcgatgactacaccaagatgaaagaggctatcctccaggtctactggcaggaattcaaggacgaccacgtggggctcatgtgcaagtttgcccagcccgctagtaagaagatcgatcagaacaagctcaaaccagagatggatgagaaggggaacctcaccaccgccggatttgcctgctcccagtgtggccagcccctcttcgtgtacaaactcgaacaggtctctgagaaaggcaaggcttatactaactacttcggaaggtgcaacgtggccgagcacgagaaactcatcctcctcgcccagctcaagcccgagaaggactccgacgaagccgtgacctactcactcgggaagtttgggcagagggctctcgatttttacagcattcatgtgactaaagaatcgacccaccccgtgaagcccctcgcccagatcgctggcaacaggtatgccagcggccccgtcggcaaggcccttagcgacgcttgcatgggcaccatcgccagctttctctccaagtaccaggacatcattattgagcatcagaaagtcgtgaaggggaaccagaagaggcttgagtccttgagggagctcgctgggaaggagaaccttgagtaccccagcgtgaccctccctccacagccccacaccaaagagggagtggatgcctacaacgaggttatcgccagagtgaggatgtgggttaacctcaacctctggcaaaagctcaaactcagcagggacgatgccaaaccactcctcaggctcaaggggtttccctcttttcccgttgttgagaggagggaaaacgaagttgactggtggaacaccatcaacgaggtgaagaagctcatcgacgccaagagagacatgggcagggttttctggagcggggtcaccgccgagaagaggaataccatcctcgagggatacaattatttgcccaatgagaacgaccacaagaagagggagggatccctcgaaaatcccaagaagcccgccaaaagacaattcggggacttgctcctctatctcgagaagaagtatgccggcgactggggcaaagtcttcgacgaggcctgggagaggatcgacaagaagatcgccgggctcacctctcacatcgagagggaggaagccagaaacgccgaagacgcccagtcaaaggcagttctcaccgactggctcagggccaaagcctccttcgtgcttgagaggctcaaagaaatggacgagaaggaattctacgcctgcgaaatccagcttcagaagtggtacggtgacctcagaggtaatccattcgccgtcgaggcagagaacagggtcgttgacatctcagggttctccattggctccgacgggcactccatccagtacagaaacctcctcgcctggaagtacctcgagaacggaaagagggagttctatttgctcatgaactacggtaagaaggggaggatcagattcaccgacggtaccgacatcaagaaatcaggaaagtggcaagggctcctctacggcgggggcaaggccaaggtcatagaccttacatttgaccccgacgacgagcagctcataatcctcccccttgcttttggcacaaggcagggaagagaattcatctggaacgacctcctcagcctcgagactgggctcatcaaactcgctaacgggagggtcatcgagaagaccatctacaacaaaaaaattgggagggacgagccagcccttttcgtcgcactcaccttcgagagaagggaggttgtggatcccagcaacatcaagcctgtgaacttgatcggcgtggatagaggcgaaaacatccccgccgtcatcgctctcaccgaccccgagggctgccccctccccgagttcaaggactcctccggcggccccaccgacatactcaggatcggcgaagggtacaaggaaaagcagagggccatccaggcagccaaggaagtggaacaaaggagggccggggggtattccagaaaattcgcctccaaaagcagaaatctcgccgacgacatggtcagaaactccgccagggacctcttctaccacgccgtgacccacgatgccgtgcttgtgttcgagaaccttagcagggggttcgggagacagggtaagaggaccttcatgaccgagaggcaatacaccaaaatggaggattggctcaccgccaagctcgcctacgagggtctcaccagcaagacttacttgagcaaaacactcgcacagtacactagcaaaacctgcagtaactgcgggttcaccatcaccaccgccgactacgacgggatgctcgtgaggctcaagaagacctctgacgggtgggcaaccacacttaataacaaggagctcaaggctgagggccagatcacctactacaacaggtataagaggcagaccgtggagaaggagctctccgccgaacttgacaggctctccgaggaaagcgggaataacgacatctccaaatggaccaagggcaggagggacgaggccctctttttgctcaagaagaggttctcccacaggcccgtgcaggagcagttcgtgtgtctcgattgcggtcacgaggtccatgccgatgagcaggccgcactcaatatcgccaggagctggctctttctcaacagtaattccaccgaattcaaatcctacaaaagcgggaagcaacccttcgttggtgcctggcaggcattctacaagagaagactcaaagaggtttggaagcccaacgcc

SEQ ID NO: 103 - DNA, 2958 bp, Artificial
  synthetic
atggagaaaaggatcaacaaaatcaggaagaagcttagcgccgacaacgcaaccaagccagtgtccaggtccggtcccatgaagaccctcctcgtgagggtgatgacagacgacttgaagaagagacttgaaaagaggaggaagaaaccagaggttatgccccaggtcataagtaacaacgctgccaacaacctcagaatgctcctcgacgactataccaagatgaaggaggccatcctccaggtgtactggcaggaattcaaggacgatcatgtgggactcatgtgcaagttcgcccagcccgcctccaaaaagatcgaccagaacaagctcaaacccgaaatggacgaaaagggcaacctcaccaccgccgggttcgcctgcagccagtgtggccagcccctcttcgtttataagctcgagcaagtgtcagaaaagggcaaagcctacacaaactacttcggcaggtgcaacgtcgccgagcacgagaaacttatcctccttgcccagctcaagcccgagaaggactccgacgaggcagtgacatacagcctcgggaagtttggccagagggctctcgacttttatagcatacacgtcaccaaagagtctacccaccccgtgaaacccctcgcccagatcgctgggaacaggtacgcctctggccccgttgggaaggccctcagtgacgcctgtatgggtactatcgcaagctttttgtccaaatatcaggatatcatcatcgaacaccagaaagttgttaaagggaaccagaagaggctcgagtccctcagggagctcgccggcaaggagaacctcgaatacccctccgtcaccctccctcctcagcctcataccaaggagggcgtcgatgcttataacgaggtgattgccagggttaggatgtgggtcaacctcaacttgtggcagaagttgaagttgtccagggacgatgccaagcccctcttgaggctcaaggggttcccctcattccccgttgtggagaggagggagaacgaggttgactggtggaacaccataaatgaggtgaaaaagctcattgacgccaagagagacatgggaagggtcttctggtccggagtcaccgccgagaagaggaataccatcctcgagggctacaactacttgcctaacgagaatgaccacaagaagagagagggcagcctcgagaatccaaagaagcccgccaagaggcagttcggggacctcctcttgtacctcgaaaaaaagtacgccggcgactggggcaaggtttttgatgaggcctgggaaaggatcgataagaagatcgctggcctcactagccacatcgagagagaggaagccaggaacgccgaggacgcccaaagcaaggccgttctcaccgattggttgagggccaaagccagttttgtcctcgaaaggctcaaagagatggacgagaaagaattctacgcctgcgagatacagctccagaagtggtatggcgacctcagggggaaccccttcgccgtggaggccgagaacagggttgtcgacatcagcgggttctcaatcgggagcgacggccattccatccagtacaggaatctcctcgcctggaagtacctcgagaatgggaagagggaattttacttgctcatgaactatggcaagaagggaaggataagatttaccgacggtaccgacatcaagaagtccggaaaatggcaaggcctcctctacggcggcggtaaggcaaaggttatcgacctcaccttcgacccagacgacgaacaactcatcattcttcctctcgccttcgggaccagacaagggagggagttcatctggaatgacctcttgtccctcgagaccggactcatcaagctcgccaacgggagggtcatcgagaagaccatctataacaaaaagatcgggagagacgaacccgccctcttcgttgccctcaccttcgaaaggagggaagtggtcgaccccagcaacatcaaacccgtcaacctcatcggtgtcgacaggggggaaaacatacctgccgttatcgccctcaccgaccccgaaggctgccccctccccgaatttaaggactcaagcggtgggcccaccgatatcctcaggataggcgagggctacaaagagaagcagagagcaatacaggccgccaaagaggtggagcagagaagggctggcggatacagcaggaagtttgcttccaagtccaggaacctcgccgacgacatggttaggaatagcgccagagacctcttctaccatgccgtgacccacgacgccgtcttggtcttcgagaacctctctaggggattcgggagacaggggaagaggacctttatgaccgagaggcagtataccaagatggaggattggctcactgcaaagctcgcctacgagggtttgacaagcaaaacctacctcagtaagacactcgcccagtatacctccaagacatgctcaaattgcggatttaccattaccaccgccgattacgacggtatgctcgtgagactcaagaagaccagcgatggatgggccaccactctcaacaacaaggagcttaaggccgaaggccagatcacctactataacagatacaagaggcaaaccgtggagaaggaactcagcgccgagctcgacagactctctgaggagagcggaaacaacgatatctctaagtggaccaagggcagaagagacgaggcactcttcttgctcaagaagaggttttcccacaggcccgtccaggaacaattcgtctgcttggactgtgggcacgaggttcacgccgacgaacaggcagccctcaacatagccaggtcctggttgttcttgaactccaatagcaccgagtttaagtcctataagagtggtaagcagcccttcgttggggcctggcaggcattctataaaaggaggctcaaggaggtgtggaaacccaacgcc

SEQ ID NO: 104 - DNA, 2958 bp, Artificial
  synthetic
atggagaagagaatcaacaagatcagaaagaagctcagcgcagacaacgccaccaagcccgtcagtagatccggacccatgaagaccctccttgtgagggtgatgactgatgacctcaagaaaagactcgagaaaaggagaaagaagcctgaggtgatgccacaagtcatctccaacaacgccgccaataacctcagaatgctcctcgacgattacactaaaatgaaagaagccatcctccaggtctattggcaggaatttaaggacgaccacgtgggactcatgtgcaagttcgcccagcccgcctccaagaagatagaccagaacaaattgaagcccgaaatggacgagaagggcaaccttaccaccgccggttttgcatgtagtcaatgcggccagccactcttcgtgtacaaactcgagcaagtctctgagaaggggaaggcctacaccaactactttggcaggtgtaacgtcgccgagcatgagaagcttatcctcttggctcagctcaagcccgaaaaggactctgacgaggccgtgacttattcccttggaaagttcgggcagagagccctcgatttctacagcatccacgtgacaaaggagagcacccatcccgtcaagcccctcgcccagatcgccgggaacaggtatgccagcggccctgtcggcaaggccctttccgacgcctgtatggggaccatcgcatccttcctcagcaagtaccaagacattatcatcgagcaccaaaaggttgttaagggcaaccagaagagactcgagtccctcagggaattggccggcaaggagaatctcgagtaccccagtgttacattgccacctcagcctcatacaaaggaaggcgtcgacgcctataacgaagtgatcgctagggttaggatgtgggtcaatctcaacctctggcagaagctcaagcttagcagagatgacgccaagcccctcctcaggcttaagggcttccctagcttcccagttgttgagaggagggaaaatgaagtggactggtggaataccatcaatgaggttaagaagctcatcgatgccaagagggacatgggcagggtcttctggagcggggttactgccgagaagaggaataccatcctcgaggggtacaactacttgccaaatgaaaacgaccacaagaagagggaaggttccctcgaaaaccccaaaaagccagctaaaagacagttcggggatctcctcctctacctcgagaaaaagtacgctggcgactggggtaaggtcttcgacgaggcttgggagaggatcgacaagaagatcgccggactcaccagccacatcgagagggaggaggccaggaatgccgaggacgcccaaagtaaggccgtgctcaccgactggttgagagccaaggccagctttgttctcgaaaggttgaaggagatggatgagaaggagttctacgcctgcgaaatccaactccagaagtggtacggcgatctcagaggaaaccccttcgccgttgaggccgagaacagggtcgtggacatttccggcttctcaatcgggagtgacggccactcaatccagtacagaaacctcctcgcctggaagtacctcgagaacgggaagagggagttttacctcctcatgaattatggcaagaaggggaggattaggtttaccgacggaactgacatcaaaaaaagcggtaagtggcagggcctcctttacggcgggggtaaggccaaagtcatcgacttgaccttcgaccccgacgacgagcagctcatcatcctccccctcgccttcggaacaagacagggcagggagttcatctggaacgaccttttgagcttggagaccgggcttatcaaactcgccaacggcagagttattgagaaaaccatctacaacaagaagatcggcagagacgagcccgctctcttcgttgccttgacattcgagagaagggaggtggtcgaccctagtaacatcaaacctgtcaacttgattggcgtcgatagaggtgaaaatatccccgccgtcatcgctttgaccgatcccgagggttgccccttgcccgaatttaaggacagttccggcgggcccaccgacatactcaggattggagagggctacaaagagaaacaaagggccatccaggccgcaaaggaggttgagcagaggagggctgggggctactcaaggaagtttgccagcaagagcagaaacctcgccgacgatatggttagaaacagtgccagggacctcttctatcacgccgttacccacgacgccgtgctcgtctttgagaatctctcaaggggattcggaaggcaagggaagaggacctttatgaccgagaggcagtacacaaaaatggaggattggcttaccgccaaacttgcctacgagggactcacctccaaaacctacttgtcaaagactctcgcccagtacaccagcaagacctgctccaattgcggcttcaccatcactaccgccgactacgatggcatgctcgttaggctcaagaaaacctcagacgggtgggccaccacactcaacaataaagagctcaaggcagaaggtcaaatcacctactacaacaggtacaagaggcaaactgtggagaaggaactcagcgccgaactcgacaggctcagcgaagaaagcggcaacaacgacatcagtaagtggacaaaaggcaggagggacgaggcccttttcctcctcaagaagaggttttcccacaggcccgtgcaagagcagttcgtctgcctcgactgcgggcacgaggttcatgccgacgagcaggccgccctcaacatcgctaggtcttggctctttttgaactccaacagtaccgagttcaaaagctacaagagcgggaagcagcccttcgttggggcctggcaggctttttacaagagaaggctcaaagaggtgtggaagcccaatgcc

SEQ ID NO: 105 - DNA, 2958 bp, Artificial
  synthetic
atggagaagagaataaacaagataaggaaaaaactctccgccgacaacgccaccaagcctgtctccaggtccgggcctatgaaaaccctccttgtgagggtcatgaccgatgacctcaagaagaggcttgaaaaaaggaggaagaaacccgaggtcatgccccaggtgatcagcaacaacgccgcaaacaacctcagaatgctcctcgatgactacaccaagatgaaggaagccatcctccaggtctactggcaggagttcaaagacgaccacgtcgggctcatgtgcaaattcgcacaacccgccagcaagaagatagatcaaaacaagctcaaaccagagatggacgaaaaagggaacctcaccaccgccggctttgcctgcagtcagtgcggtcaacccctctttgtttacaaactcgaacaggtgagcgagaaagggaaagcctacacaaattactttggaagatgcaacgtcgctgagcacgaaaagttgatcctcctcgcccagttgaagcccgagaaggattctgatgaggccgtcacctattccctcgggaaattcggccagagggccctcgatttctacagcatccacgttaccaaggagagcacccaccccgtgaagcccctcgcccagatcgccggcaataggtatgcctccggcccagtgggcaaggccctctccgacgcttgtatgggaaccatcgcctcctttcttagcaaataccaggacattatcatcgagcaccagaaagtggtgaagggcaaccagaaaagactcgagtccctcagggagctcgccgggaaggagaacttggagtaccccagcgtgaccctccccccccagccccacaccaaggaaggggtggacgcctacaacgaagttatcgccagagtcaggatgtgggtgaacctcaacctctggcagaagttgaagctctcgagggatgacgccaagcccctcctcaggctcaagggatttcccagcttccccgtcgtggaaaggagggagaacgaagtggactggtggaacaccattaatgaagtgaagaagctcatcgacgcaaagagggatatgggcagggtcttctggtccggagtcacagctgagaagaggaacaccatcctcgaggggtacaactacttgcccaacgaaaacgaccacaagaaaagggagggcagtttggagaatcccaagaaacctgccaagaggcagttcggagacctcctcctctacctcgagaagaagtacgccggggattgggggaaggttttcgacgaggcctgggagaggattgacaagaagatcgccggcttgaccagccacatcgaaagagaggaggcaaggaacgccgaagacgcccaaagcaaggctgtcctcaccgattggctcagggccaaggccagcttcgtcctcgagaggctcaaggagatggacgagaaagaattctacgcctgcgagattcagttgcagaagtggtatggggacctcaggggaaaccccttcgccgtggaggccgagaacagggtggtcgatatcagcgggttcagcatcggatcagacggtcactcaattcagtacaggaatctcttggcctggaagtatctcgagaacggcaagagggagttctatctccttatgaactacggcaagaagggcaggatcaggttcaccgacgggaccgacataaaaaagagcggcaagtggcagggcctcctctacggaggtgggaaggccaaagtcatcgatctcaccttcgacccagacgacgagcagctcatcatcctccccttggccttcgggacaaggcaaggaagggagtttatctggaacgatcttctcagcctcgagaccggcctcatcaagcttgccaacgggagagtgatcgagaaaaccatctacaacaagaaaataggaagggacgagcccgcactcttcgtcgctttgaccttcgagaggagggaggttgtggacccttccaacattaagcccgtgaacctcataggcgtcgacagaggcgagaatatccccgccgtgatcgccctcaccgatcccgagggctgtcccctccccgagttcaaggactcctctgggggccccaccgacatcctcaggatcggcgaaggctacaaggagaagcaaagggccatccaggcagcaaaggaggtcgaacaaagaagggccggggggtactccaggaagttcgcctccaagtccaggaacttggccgacgacatggtgaggaacagcgccagagacctcttctaccacgccgtcacccacgatgcagtcctcgtcttcgagaacctctccagagggttcgggagacaggggaagagaacctttatgaccgagaggcagtacaccaagatggaagactggctcactgcaaaactcgcctacgagggcctcacctccaaaacatacctctccaaaacactcgcccagtatacctccaagacctgctcaaactgtgggttcacaatcaccaccgctgactacgacgggatgttggtgaggctcaagaagacatccgacgggtgggccaccaccctcaacaataaagaacttaaggcagagggccaaatcacctactacaacaggtacaaaaggcagaccgtggagaaagaattgtccgccgagttggacagactttccgaagagtccggcaacaacgacatttccaagtggaccaaggggaggagggatgaggcactcttcttgctcaaaaagaggtttagtcatagacccgtccaggagcagttcgtctgcctcgactgcgggcacgaagtccacgccgacgagcaggccgccctcaatatcgctagaagctggcttttcctcaactcaaatagcaccgagttcaaatcctacaagagcggaaagcaacccttcgttggcgcctggcaggccttctacaagcgaagactcaaggaggtctggaagcccaacgct

SEQ ID NO: 106 - DNA, 2958 bp, Artificial
  synthetic
atggagaagaggattaataagatcaggaagaagctttccgccgacaatgccaccaagcctgtttccagaagcggtcccatgaaaacccttctcgtccgcgtcatgactgacgacctcaaaaagaggctcgagaagaggaggaagaagccagaggtgatgccccaggtcatcagtaacaacgccgcaaataacctcaggatgttgttggacgactacaccaagatgaaggaggccatcctccaggtctactggcaggaattcaaggacgaccacgtcggcctcatgtgcaagtttgctcagcccgcctctaaaaaaatcgaccagaacaagctcaaacccgaaatggatgagaaggggaaccttaccaccgccggcttcgcctgcagccagtgtggacaacctctctttgtctataagctcgagcaagtgtccgagaagggcaaggcctacaccaactactttggcaggtgcaacgttgccgagcatgaaaagcttatcctcctcgcacaacttaagcccgagaaggactccgacgaggccgtcacctacagcctcggaaaatttggccagagggccctcgacttctactcaatccacgtcactaaggagagtacccatcccgtgaagcccctcgctcagatcgccgggaacaggtatgcctccgggcccgtggggaaggccttgagtgacgcctgcatgggtaccatcgctagcttcctcagcaagtaccaggacatcatcatagagcaccagaaggtcgttaagggcaaccagaagaggctcgagtctctcagggagctcgccggcaaagagaatttggagtaccccagcgttacccttcccccccagccccataccaaggagggtgtggacgcctacaacgaggttatcgccagggtgaggatgtgggtgaacctcaacctctggcaaaagctcaagctcagcagggatgatgccaaacccctcctcagattgaagggcttcccatccttccccgtcgtcgagaggagagaaaacgaggtcgactggtggaatactattaatgaagtcaaaaagctcatcgatgccaagagggatatgggaagggtgttttggtccggcgtcaccgccgagaagaggaacaccatcctcgagggatacaactacctccccaacgaaaacgaccacaaaaaaagagaggggtcccttgaaaaccccaagaagcccgccaagaggcagtttggggatctcctcctctacctcgagaagaagtacgctggcgactggggaaaggtgttcgacgaagcctgggagaggatcgacaaaaagattgctggacttacctcccacattgagagggaggaggctaggaacgcagaagacgcccaatccaaggccgtgctcaccgactggttgagggcaaaagcctcattcgttctcgagaggctcaaagaaatggatgaaaaggaattttacgcctgcgaaatccagttgcagaagtggtacggggatctcagggggaaccccttcgccgtggaagcagaaaacagagttgtcgacatcagcggcttcagcatcgggagtgacggacacagcatccagtacaggaacctcctcgcctggaaatacctcgaaaacggcaagagggagttctacctcctcatgaactatggcaagaaggggaggatcaggttcaccgacgggactgacatcaagaaatccggaaaatggcagggactcctctacggggggggcaaggcaaaggtgatcgatctcaccttcgaccccgacgacgagcagctcatcatcctccccttggcctttgggaccaggcaagggagggagtttatctggaacgacctcctctctctcgaaactgggctcatcaagctcgccaacggcagagttatcgaaaagaccatctataacaaaaagatcggtagggacgagcccgcacttttcgtggccctcacctttgagaggagggaggtggttgacccttccaacatcaagccagtcaacttgataggcgttgataggggggaaaacattccagccgtcatagcactcaccgaccctgaggggtgtcccctccccgagtttaaagactcatctgggggccccactgacatactcaggatcggggaggggtataaggagaagcagagggccatccaggccgccaaagaagtggagcagaggagggccggcggttactcaaggaagttcgcctccaaaagcagaaacctcgctgacgacatggtcagaaactccgcaagggacctcttctaccatgccgttacccacgacgccgtcctcgtcttcgagaacctcagcaggggcttcgggagacagggcaagagaacctttatgacagagaggcagtataccaagatggaagactggctcaccgccaaactcgcatacgaggggcttaccagcaagacctacctctccaagacattggcccagtacacaagcaaaacctgctccaattgcggattcaccatcaccaccgccgactacgacggcatgctcgtcagactcaagaagacaagcgacgggtgggccaccaccctcaacaacaaggaacttaaagccgagggacaaatcacctactacaacaggtataagaggcaaaccgttgagaaagagctcagtgccgagttggacaggctctctgaggagtccgggaacaacgacatctccaagtggaccaaaggcaggagggacgaagctcttttcctcctcaagaagaggttctcccacaggcccgtccaggagcaatttgtctgtctcgactgcgggcacgaggttcacgccgacgagcaggccgccctcaacatcgccaggagttggctctttctcaactcaaactccaccgagttcaagagctataagtccgggaagcagccctttgttggcgcctggcaagctttctacaagagaaggctcaaagaggtctggaaacccaacgct

SEQ ID NO: 107 - DNA, 2958 bp, Artificial
  synthetic
atggagaaaaggatcaacaagatcaggaagaagctcagcgccgacaacgccaccaagccagtttccaggtcaggccctatgaagactctcctcgtcagggtgatgactgacgacctcaagaaaagactcgaaaagagaaggaagaaacccgaggttatgccccaggtcataagcaacaacgccgccaacaatctcagaatgcttctcgatgattacaccaagatgaaagaggccatcctccaggtttactggcaagagtttaaggatgatcacgtggggcttatgtgtaagtttgcccaacccgcctccaagaagattgaccaaaacaaactcaagcccgagatggatgagaagggtaacctcacaaccgccggcttcgcctgcagccagtgcgggcagcccctcttcgtgtacaagctcgagcaggtcagcgagaagggcaaagcctacacaaactacttcggcaggtgcaacgttgccgagcacgagaaactcatactcctcgcccagctcaagcccgagaaggacagtgacgaggcagtgacctactccctcggcaagttcgggcagagggccctcgacttctacagcatccacgtgaccaaggaaagcacccaccctgttaagccccttgcccagattgccgggaacaggtacgcttctgggcccgtcgggaaagccctcagcgacgcctgcatggggaccatcgccagcttcctctcaaagtaccaggacatcatcatagagcaccaaaaggtcgtgaaaggcaaccagaagaggctcgagagtctcagagagctcgccggcaaagagaacctcgagtatccctctgtcaccctcccaccccaaccccacaccaaggagggggtcgacgcctacaacgaggtgatcgccagggttaggatgtgggtgaacctcaacctctggcagaagcttaagctctcaagggacgatgccaagccccttcttaggctcaaagggttcccctccttccccgttgtcgaaaggagggagaacgaggtcgactggtggaacaccatcaatgaggttaagaaactcatcgacgcaaagagggacatggggagagtcttctggagcggagttaccgccgagaagagaaacaccatcctcgaagggtataattaccttcccaacgagaacgatcacaagaaaagagaagggagcctcgagaaccccaagaagcccgcaaagaggcagttcggcgacttgctcctctacctcgaaaagaagtacgccggggactgggggaaggtcttcgacgaggcctgggagaggatcgacaagaagatcgccgggttgacctcccacatcgagagggaagaggccaggaacgctgaggacgcccaaagcaaggcagtgctcaccgactggctcagagccaaggcctcattcgtcctcgaaagacttaaagagatggacgaaaaagagttctacgcctgcgagattcagctccagaaatggtacggggatctcagagggaatcccttcgccgtggaggcagaaaacagagtggttgatatcagcgggtttagcatcggcagcgacgggcatagcatccagtataggaatttgctcgcctggaagtacctcgagaacggcaagagggagttctatctcctcatgaattacggcaaaaagggcagaatcagatttaccgacggcaccgacataaagaagagcgggaagtggcaagggctcctctatggggggggaaaagccaaggtcatcgatctcaccttcgaccccgacgacgagcagctcatcatactccccctcgctttcgggaccaggcaggggagagagttcatctggaacgacttgctctcactcgagaccgggcttataaagctcgccaacggcagggtgatcgagaagactatctacaacaagaagatcgggagagacgagcccgctctcttcgtcgctctcacctttgagaggagggaggtcgttgacccctccaacataaagccagtgaaccttatcggcgtggacagaggcgagaatatcccagccgtgatcgcactcactgaccccgaggggtgccccctcccagagttcaaggactcctccggtgggcccacagacatcctcaggatcggtgaaggctacaaggaaaagcagagggccatccaggctgccaaagaagtcgagcagaggagggccggcgggtattccaggaagttcgcctccaagagcaggaacctcgcagatgacatggtcaggaacagcgccagggacctcttttatcatgcagtgacccacgacgccgtgctcgtcttcgagaacctctcaagagggttcggcaggcaagggaagaggaccttcatgaccgagaggcagtacaccaaaatggaggattggcttaccgccaagctcgcttatgagggcttgaccagcaagacctacctcagtaagaccctcgcccaatacactagcaaaacctgctcaaactgcgggttcaccatcactaccgccgactatgacggtatgctcgtcaggcttaagaagacctccgacggttgggccacaaccttgaataataaggagctcaaagccgagggccagataacctactacaacaggtataagaggcagaccgtcgaaaaggagttgtccgccgaactcgacaggttgtccgaggaatccgggaacaacgacatcagcaagtggaccaagggcaggagggacgaggccctctttcttctcaagaagaggttcagccataggccagtgcaggagcagttcgtgtgccttgactgcggccacgaagtccacgcagacgaacaagccgctctcaatatcgccaggagctggctctttttgaactccaacagcaccgagttcaagtcctacaagtccgggaaacagccattcgttggtgcctggcaggccttctacaaaagaagactcaaagaagtctggaagcccaacgcc

SEQ ID NO: 108 - DNA, 2958 bp, Artificial
  synthetic
atggaaaagaggatcaacaagattaggaagaaactctctgccgacaacgccaccaagcccgtgtcccgttctgggcccatgaaaaccctcctcgtcagggttatgaccgacgacctcaagaaaaggcttgagaaaagaaggaagaagcctgaggtgatgccccaggttatctccaacaacgccgcaaataatttgaggatgctcttggacgactataccaagatgaaagaggctatactccaagtctattggcaggagttcaaagatgaccacgtggggctcatgtgcaagttcgcccagcccgccagcaagaaaatcgaccagaacaagctcaagcccgagatggacgagaagggcaacctcaccaccgccggtttcgcctgctcccagtgtgggcagcccctcttcgtttacaaactcgagcaggtgagcgagaagggcaaagcctacaccaactacttcggcagatgcaacgtcgctgagcacgagaagctcatcctcctcgcccaactcaagccagagaaggactccgatgaggccgtgacctacagcctcgggaagtttggacagagagcccttgatttctacagcatccacgtgaccaaagagtccacccacccagtgaagcccctcgcccaaatcgccggaaacaggtacgcctctgggcctgtcgggaaggctctctccgacgcctgcatgggcacaatcgccagcttcttgagcaagtaccaggacatcatcatcgaacaccagaaagtggtgaaggggaaccagaaaaggctcgagtccctcagagaattggccggtaaggagaacctcgagtaccccagcgtgaccctccccccccaaccccataccaaagagggtgtcgatgcatataacgaggtcatcgccagggtcagaatgtgggtcaacctcaatctctggcagaagttgaaactcagtagggatgacgctaaacccctcttgaggctcaaggggtttcccagcttccccgttgtggagaggagggagaatgaggtcgactggtggaacaccatcaacgaggtgaagaagttgatcgacgccaagagggacatggggagggtgttctggtccggcgtgaccgccgagaaaaggaacaccatcttggagggttacaactacctccccaacgagaatgaccacaaaaagagggaggggtccctcgaaaaccccaaaaaacccgccaagaggcagttcggggacctccttctctatttggaaaagaagtacgccggagactgggggaaagtctttgatgaggcctgggagaggattgacaagaagatcgcagggttgaccagccacatcgagagggaagaggccaggaacgccgaagacgcccagtccaaggccgttctcactgactggttgagggccaaggcctctttcgtgctcgagaggctcaaggagatggacgaaaaggaattttatgcctgcgagatccaactccagaaatggtacggcgatctcaggggcaacccatttgccgtcgaggccgaaaatagggtggttgacatatccgggttctctatcggctccgacgggcactccatccagtacaggaacctcctcgcctggaagtacctcgaaaacggaaagagggagttttacttgctcatgaattatggcaagaagggcaggattaggtttaccgacggaaccgacataaaaaagagcggcaagtggcaaggcctcctctacggggggggcaaagccaaggtcatcgacctcaccttcgaccccgacgacgagcagctcatcatacttcccctcgccttcggcaccagacaggggagggaattcatttggaacgacctcttgtccctcgagaccggcctcatcaaactcgctaatggcagagtgatcgaaaagactatctacaacaagaagatcgggagggacgagcctgccctcttcgtggctcttacattcgagagaagggaggttgtggatccctccaatatcaagcccgtcaacctcataggcgtcgacaggggggagaatatccccgccgtcatagccctcaccgaccccgaggggtgtcccctccccgagttcaaagactcctccggcggccccaccgacatactcaggataggggaggggtacaaggagaaacagagagccatacaggcagccaaggaggtcgagcagaggagggcaggcggttacagcaggaagttcgcctccaaatccagaaacctcgccgacgatatggtcagaaactccgcaagggatctcttttaccacgctgtgacccatgacgccgtgctcgtgttcgaaaacctctccaggggattcggcaggcaaggtaaaaggaccttcatgaccgagaggcagtacaccaaaatggaggactggctcactgccaaattggcctacgagggtctcaccagtaaaacatacttgtccaaaactctcgcccagtatacctccaagacatgctccaattgcgggtttaccataaccactgccgactatgatggcatgttggtcaggcttaagaagacctccgacgggtgggccactaccctcaataataaggagttgaaggccgaaggccagatcacctactacaataggtacaagaggcaaactgttgagaaggaactctcagccgaactcgacagactctccgaggagtccggcaacaacgacatctccaagtggaccaaagggagaagggacgaagcccttttccttcttaagaaaagattttcacacaggcccgtccaggagcagttcgtctgcttggactgtggccatgaagtgcacgccgacgagcaggctgccctcaatatcgccaggagctggctcttcctcaatagcaacagcaccgagtttaagagttacaagagcggcaagcaacccttcgtcggggcctggcaggctttctataagaggagacttaaggaggtttggaagccaaatgcc

SEQ ID NO: 109 - protein, 531 aa, Artificial
  synthetic
EASGSGRADALDDFDLDMLGSDALDDFDLDMLGSDALDDFDLDMLGSDALDDFDLDMLINSRSSGSPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRIRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLF

SEQ ID NO: 110 - protein, 20 aa, Artificial
  synthetic
  VARIANT (4)..(4): Xaa is lysine, histidine, or arginine
  VARIANT (8)..(8): Xaa is lysine, histidine, or arginine
  VARIANT (11)..(11): Xaa is lysine, histidine, or arginine
  VARIANT (15)..(15): Xaa is lysine, histidine, or arginine
  VARIANT (19)..(19): Xaa is lysine, histidine, or arginine
GLFXALLXLLXSLWXLLLXA

SEQ ID NO: 111 - protein, 20 aa, Artificial
  synthetic
GLFHALLHLLHSLWHLLLHA

SEQ ID NO: 112 - protein, 7 aa, Simian virus 40
PKKKRKV

SEQ ID NO: 113 - protein, 23 aa, Zea mays
RKRKESNRESARRSRRSRYRKKV

SEQ ID NO: 114 - protein, 14 aa, Simian virus 40
ASPKKKRKVEASGS

SEQ ID NO: 115 - protein, 11 aa, Human immunodeficiency virus type 1
YGRKKRRQRRR

SEQ ID NO: 116 - protein, 5 aa, Artificial
  synthetic
GSGGS

SEQ ID NO: 117 - protein, 6 aa, Artificial
  synthetic
GGSGGS

SEQ ID NO: 118 - protein, 4 aa, Artificial
  synthetic
GGGS

SEQ ID NO: 119 - DNA, 18 bp, Unknown
  bacterial
atttctactattgtagat

SEQ ID NO: 120 - protein, 707 aa, Unknown
  bacteriophage
MADTPTLFTQFLRHHLPGQRFRKDILKQAGRILANKGEDATIAFLRGKSEESPPDFQPPVKCPIIACSRPLTEWPIYQASVAIQGYVYGQSLAEFEASDPGCSKDGLLGWFDKTGVCTDYFSVQGLNLIFQNARKRYIGVQTKVTNRNEKRHKKLKRINAKRIAEGLPELTSDEPESALDETGHLIDPPGLNTNIYCYQQVSPKPLALSEVNQLPTAYAGYSTSGDDPIQPMVTKDRLSISKGQPGYIPEHQRALLSQKKHRRMRGYGLKARALLVIVRIQDDWAVIDLRSLLRNAYWRRIVQTKEPSTITKLLKLVTGDPVLDATRMVATFTYKPGIVQVRSAKCLKNKQGSKLFSERYLNETVSVTSIDLGSNNLVAVATYRLVNGNTPELLQRFTLPSHLVKDFERYKQAHDTLEDSIQKTAVASLPQGQQTEIRMWSMYGFREAQERVCQELGLADGSIPWNVMTATSTILTDLFLARGGDPKKCMFTSEPKKKKNSKQVLYKIRDRAWAKMYRTLLSKETREAWNKALWGLKRGSPDYARLSKRKEELARRCVNYTISTAEKRAQCGRTIVALEDLNIGFFHGRGKQEPGWVGLFTRKKENRWLMQALHKAFLELAHHRGYHVIEVNPAYTSQTCPVCRHCDPDNRDQHNREAFHCIGCGFRGNADLDVATHNIAMVAITGESLKRARGSVASKTPQPLAAE

SEQ ID NO: 121 - DNA, 2121 bp, Artificial
  synthetic
atggcagatacgcccactctttttacacagtttctcaggcatcacttacctggtcaacggttccgtaaggacatcttgaagcaagctggacgtattcttgccaacaagggagaggatgctaccatcgcatttcttaggggtaagtctgaagaaagtcccccagattttcaacctccagttaaatgccctatcattgcttgcagcagaccattgactgaatggcctatataccaggcaagtgtggcaatccaaggatacgtctacggccaaagtcttgctgagtttgaagcaagtgatcccggatgttcaaaggatgggctattgggctggttcgataagaccggagtttgtactgactacttttcagttcaaggtttgaacttaatattccagaatgctcgtaaaagatacattggagtccagaccaaggttacgaatagaaatgaaaaacgccacaagaaattaaagagaatcaacgccaagagaatagcagagggcttgccagagctaacttcagatgagccagaatccgctctagacgaaacgggacatttgatcgacccacctgggttgaacaccaatatctattgttaccagcaggtcagccccaagccattggctctgtcagaagtgaaccaattgccgactgcatacgcgggttactctacgtccggtgatgatcccattcaacccatggttacgaaggaccgcttaagtatctctaagggacaaccaggatatatccccgaacaccaaagagcactcctctctcaaaaaaagcacagacgcatgagagggtacgggttaaaggcccgcgctttacttgtgatcgtgcgaattcaagatgattgggcagttattgaccttagatccttgttgagaaacgcatactggagaagaattgttcagactaaagaaccttcgacgattacaaaacttttaaagttagttacaggggaccccgttctcgatgcaacacggatggttgctacattcacttacaagcctggaatagtgcaggttagaagtgcaaagtgtctcaagaataagcaaggaagtaaattgttctctgagaggtatctcaacgagacagtttcggttacttcaattgacctcggatcgaataatttagttgctgttgcaacatatagattggttaatggtaacacaccagaacttcttcaaaggtttaccttaccatcacacttggttaaggatttcgagagatataagcaagcgcacgacactttggaggatagcatccagaaaactgctgtagcgtccttaccgcagggacagcaaacagaaataagaatgtggtcgatgtacggattcagagaggcacaagaaagggtgtgccaagagttggggctagccgacggatcaatcccatggaatgtgatgacggcaacttcgaccattttgactgatctgttcctcgcgagaggcggggaccctaaaaagtgtatgttcacatccgaacctaaaaaaaaaaagaatagcaaacaagtcttgtataagatccgcgatcgggcttgggcaaaaatgtatcgtacattactctccaaggagacccgcgaagcatggaataaagccttgtgggggcttaagagaggtagtcctgattacgcccgcttatcaaaacgtaaagaagagctcgctaggcgttgtgtgaactacacgatttctactgctgaaaagagggcccagtgcggacgtacaattgttgcactcgaggacttgaacatcgggttcttccacggtagagggaagcaagagcctggatgggttggtttgttcacaaggaaaaaggagaatcgctggttgatgcaggctcttcacaaagcttttttggagctcgcgcatcataggggctaccatgtcattgaggttaaccccgcttacacgagtcagacttgccccgtttgtcgtcactgtgatccagataaccgggatcaacataatagggaagcatttcattgtattggttgcggattcagaggcaacgcagatttggacgttgctacccacaacattgcgatggtggctataactggagagtcattgaaaagggccagagggtctgttgcatcaaagacccctcagccattagcggctgag

SEQ ID NO: 122 - DNA, 2121 bp, Artificial
  synthetic
atggccgacacccctaccctcttcactcagttcctcaggcaccacttgccagggcagaggtttaggaaggacatcctcaaacaggccgggaggattctcgccaacaagggtgaggacgccaccatcgccttcctcaggggcaagtccgaggagtcccccccagactttcagcccccagtgaagtgcccaatcatcgcctgcagcaggcccttgactgagtggcccatctaccaggccagcgtcgccatccagggatacgtgtacgggcagagcctcgccgagttcgaggccagcgaccctggatgctctaaggacggcctcctcggttggttcgacaaaaccggcgtgtgcaccgactacttttccgtgcaagggctcaaccttatcttccaaaacgccagaaagaggtacattggagtccagactaaagtgaccaacaggaacgagaaaaggcacaaaaagctcaaaaggatcaatgccaagaggatcgccgagggcctccccgagctcacctccgatgagcctgagtccgccctcgacgagactgggcacctcatcgaccctcctggtctcaacaccaacatctattgctaccagcaagtgtctcccaagccactcgccttgagcgaagtgaaccaactccccacagcttacgcaggctacagcacatccggtgacgatcccatccagcccatggtcaccaaggacaggctcagtatcagcaagggtcagcccgggtacatccccgagcaccagagggccctcctcagccagaaaaaacacaggagaatgagaggctacggactcaaagctagggcccttctcgtgatcgtgagaatacaggacgactgggccgtcatcgacctcaggagcctcctcaggaacgcctactggagaaggatcgttcagacaaaggagccctccaccatcaccaaacttctcaaattggtcaccggggaccccgtcctcgacgccaccaggatggtggccacattcacctataagcctgggattgtccaggtgaggagtgccaagtgcctcaagaacaagcaggggagcaaactcttcagcgagagatacttgaacgaaaccgtttccgtgacctccatcgatttggggagcaacaacctcgtggccgttgccacatacagactcgttaatggaaacacccccgagttgctccagagattcaccttgccttcacatttggttaaggattttgagaggtacaagcaagcccatgacaccctcgaggatagcatccagaagaccgccgttgcctccctcccccaggggcagcagactgagatcagaatgtggagcatgtacggctttagagaagcccaggagagggtttgccaggagctcggcctcgccgacggcagcatcccctggaacgttatgactgccaccagcaccatactcaccgacctcttcctcgccagaggcggcgatcccaagaagtgcatgtttacatccgagcccaagaagaagaagaacagcaagcaggtcctctacaagatcagggacagggcttgggccaagatgtacagaaccctcctcagcaaggagaccagggaggcctggaataaagctctctggggcctcaagagggggagccccgattacgccaggctcagtaagaggaaggaggagttggcaaggaggtgcgtgaattacactattagcactgccgagaagagagcccagtgtggtaggactatcgtcgccttggaagacctcaacatcggcttctttcatggcagaggcaaacaagagcctggttgggtcgggctctttaccaggaagaaagagaacaggtggctcatgcaggctctccacaaggccttcctcgaactcgctcatcacaggggctaccacgtcatcgaagtgaatcccgcttacaccagccaaacctgcccagtttgcaggcactgtgatcccgacaatagggaccagcacaacagggaggcttttcattgtatcggctgcgggttcagaggaaacgccgatctcgacgtcgcaacacacaatatcgccatggttgccatcacaggagaatccctcaaaagggcaagggggagcgtggcctctaagactccccagccccttgctgccgaa

SEQ ID NO: 123 - DNA, 2121 bp, Artificial
  synthetic
atggccgacaccccaactctcttcactcagttcctcagacaccacttgcccggacagaggttcaggaaagacatcctcaagcaggccggcaggattctcgccaacaagggggaggatgccaccatcgccttcctcaggggcaaaagcgaagagagccctcccgacttccaaccccccgtgaagtgccccatcatcgcctgctccagacccctcaccgagtggcccatctaccaagccagcgtcgccatccaggggtatgtgtatggccaaagcctcgctgagtttgaggcatctgatcccggctgcagcaaagatggcctcttgggctggttcgacaaaaccggcgtttgcaccgattatttcagcgtgcagggcttgaatcttattttccagaacgccagaaagagatacataggtgtgcagactaaggttaccaacagaaatgaaaaaaggcacaagaagctcaaaaggattaacgccaagaggatcgccgagggcctccccgaactcacctccgacgaacccgaaagcgccctcgatgagaccggacacttgatcgacccccccgggctcaataccaacatctactgctaccaacaagtctcccccaagcccctcgcactcagcgaagtcaaccagttgcccacagcctacgccggttactccacttccggggacgacccaatccagccaatggttaccaaggacaggctctctatcagtaaggggcagcccggatacataccagagcaccagagagctctcttgagccaaaagaagcataggaggatgagaggctacgggctcaaggccagagccttgctcgtgatcgttaggatccaggacgactgggccgttatcgacctcagatcactccttagaaacgcctactggaggaggatcgtccaaaccaaggagccctccaccatcaccaagcttctcaagttggtgactggggatcccgttctcgacgccaccaggatggttgcaaccttcacctacaagcccggcattgtccaagtcaggagcgccaaatgcctcaagaacaagcaagggagcaagctcttttccgagaggtacctcaatgagaccgtgtccgtgacttcaatcgatttggggtctaacaacctcgtggccgtcgccacctacagactcgtgaatgggaacacccccgagctccttcaaaggttcaccctcccttcccaccttgtgaaggacttcgagaggtacaaacaagcccacgatacccttgaggacagcattcagaagactgctgtcgccagccttccccagggccagcagaccgagataagaatgtggagcatgtacgggttcagagaggcacaggagagggtctgccaagagctcggactcgccgacggtagcatcccctggaacgttatgaccgctacctccaccatccttacagacctcttcctcgccaggggcggggaccctaaaaagtgcatgtttacctccgaacccaagaagaagaagaactccaaacaggtgctctataagatcagggacagggcctgggctaaaatgtatagaaccctcctctccaaggagaccagggaggcctggaacaaggccctctggggtctcaagaggggatcccccgattacgccagactctcaaagagaaaggaagagctcgccagaaggtgtgtgaactacacaattagcaccgccgagaaaagggcccagtgtgggaggacaatcgtggccctcgaagacctcaatatcggcttcttccacgggagaggcaaacaggagcccggctgggtgggcctctttaccaggaaaaaggagaacaggtggctcatgcaggccctccacaaggcctttctcgagcttgcccaccataggggctaccacgtgatcgaagttaaccccgcctataccagccagacatgcccagtctgcaggcactgcgatcctgacaacagagaccagcacaacagagaggcttttcactgtatcgggtgcgggttcagggggaacgccgacctcgacgtggcaacccacaatatcgctatggtcgccatcacaggggagagcctcaagagagctaggggtagcgttgcttccaagaccccccaacccctcgctgccgaa

SEQ ID NO: 124 - DNA, 2121 bp, Artificial
  synthetic
atggccgacacccccacactcttcacccagttcctcaggcatcaccttcccgggcaaaggttcaggaaggacatcctcaaacaagccgggaggatcctcgccaacaagggcgaggacgccaccatcgccttcctcagggggaagtccgaagagtccccgcccgacttccagccccccgtcaaatgccccataatagcctgctccaggcctctcactgagtggccaatctaccaggcctccgtggccatccagggatacgtctacgggcagagcctcgccgagttcgaagcctccgaccccggctgcagcaaggacggattgctcggctggttcgacaaaaccggcgtctgtaccgactacttctcagtgcagggcctcaaccttatcttccagaacgccaggaagaggtatattggcgtccagaccaaggtcaccaacaggaacgagaagaggcacaagaagttgaagagaatcaacgccaaaaggattgctgagggtctccccgaactcacctcagatgagccagagtccgcactcgacgagaccggtcacctcatcgacccacctgggctcaacaccaacatctactgctaccaacaggtgagccctaagcccttggccctctctgaagtgaaccagttgcccactgcctacgcaggctattccacctcaggagacgatcctatccaacccatggtgaccaaggataggctctcaatctcaaagggccagcccggttacatccccgagcaccagagagccctcctctcccaaaagaagcacaggaggatgagaggctacgggctcaaggccagagccctcctcgtgatagtgaggatccaggacgactgggccgtgatcgacttgaggagcctcctcaggaacgcatactggaggaggattgttcagaccaaggagcccagcaccatcaccaagttgcttaagctcgttaccggagatcccgtcctcgacgccactaggatggttgccacctttacctataagcccggcatcgtccaggtcaggtcagccaagtgcctcaagaataagcagggctccaagcttttctccgaaaggtacctcaatgagaccgtctccgtgacctccattgatctcgggagcaataacttggtcgccgttgccacctacaggctcgtcaacggtaacacccccgaattgctccaaaggttcaccctcccaagccatctcgtcaaggactttgagaggtacaagcaggcacatgataccctcgaggactccatccagaaaaccgccgtcgcctccctcccccagggccagcagaccgaaatcaggatgtggtcaatgtacggctttagggaagcccaagagagggtctgtcaagagctcgggctcgccgacgggagtattccctggaacgtcatgaccgccacctccaccatcctcaccgacctcttccttgccagagggggagaccccaagaaatgcatgtttacctccgaacctaagaagaagaaaaactccaagcaggtcctctataagatcagggacagggcctgggccaagatgtatagaactcttctctccaaggagaccagagaggcttggaacaaggccctctggggccttaaaagagggtctcccgactatgcaaggttgagcaagagaaaagaggagcttgcaaggaggtgcgtcaactacaccatctccacagcagagaaaagagcccaatgtggcaggaccatcgtcgcccttgaagaccttaatatcggctttttccacggtagggggaagcaggagcctggctgggtgggcctcttcaccaggaagaaagaaaacaggtggcttatgcaagccttgcacaaggccttcctcgaactcgcccaccatagagggtaccacgtcatcgaggttaatcccgcctacaccagccagacctgccccgtctgtaggcactgcgacccagacaatagggaccaacacaacagagaggccttccattgtatcggttgcggcttcagaggcaacgccgatcttgacgtcgctacccacaatatcgccatggtcgccatcaccggggagagcctcaaaagggccagggggagcgttgcctctaagaccccccagccccttgcagccgag

SEQ ID NO: 125 - DNA, 2121 bp, Artificial
  synthetic
atggccgacacccccaccctgttcacccagtttcttaggcatcacctccccggccagagattcaggaaggacatcctgaaacaggcaggtaggatcctggccaacaagggagaagatgctaccatcgcctttctgagggggaagtccgaagagagtccccctgactttcagcctcccgtgaagtgccctataatcgcctgttccagacccctgaccgaatggccaatctaccaggcctcagttgccatccaagggtacgtgtacggccaatcactggcagaatttgaagcatccgaccccgggtgttccaaagacggcctcctgggctggttcgacaagaccggggtgtgcaccgactacttctccgtccagggcctcaacctcatctttcaaaacgccaggaagaggtacatcggggttcagaccaaggtgaccaacaggaatgaaaagaggcacaaaaagttgaagaggatcaacgccaagaggatagcagagggcctgcccgaactcacctccgacgagcccgagtccgccctggatgaaaccgggcacctgatcgacccacccgggctgaacaccaatatctattgctatcaacaggtgtctcccaagcccctcgccctctcagaggttaaccagctgcccactgcctacgccggctacagtacctctggagatgaccctattcaacccatggttaccaaagacagactgtccatttccaagggccaacccggctacatccccgaacatcagagagccctcctttcccagaagaaacatagaaggatgaggggctatggcctcaaggccagggcacttttggtgatcgtgaggatccaggacgattgggccgtgatcgacctgaggtccctgcttaggaatgcatactggagaaggatagttcagaccaaggagccctccaccatcaccaagctgcttaagctggtgacaggggaccctgtcctcgacgcaactagaatggtggccacattcacctacaagcccggaatcgttcaggtgagaagtgccaagtgcctcaagaacaagcagggatctaagcttttctccgagaggtacctgaatgagactgtgtccgttacctccatcgacctgggttccaataatctcgtggccgtggcaacttacaggctggtgaacggcaacacccccgaattgctgcagaggttcactttgccctcacacctggtgaaagacttcgaaaggtacaaacaagcccacgatacattggaggacagtatccagaagaccgcagtggcctccttgccccagggccaacagaccgagatcaggatgtggtccatgtacgggttcagggaggcccaggaaagagtgtgccaggagctgggtcttgccgacgggtcaatcccctggaacgtcatgaccgcaacctccaccatcttgactgatctttttctggctagagggggcgaccccaaaaagtgcatgttcacctccgagccaaaaaagaaaaagaattctaaacaggtgctgtacaagatcagggacagagcctgggccaaaatgtacagaactctcctgtcaaaggaaacaagggaagcatggaataaggccctgtggggcctgaagagggggtcccccgactatgccaggctctccaagaggaaggaggaactggccagaaggtgcgtcaactacaccatctccaccgccgaaaaaagggctcagtgcgggaggactatcgtggccctggaggacttgaacatcggctttttccatggaagaggcaagcaggagccagggtgggttggcctctttaccaggaaaaaggagaataggtggctgatgcaggcactgcacaaggccttcctcgaactcgcccaccatagggggtatcacgttatcgaggttaaccccgcttacacctcccaaacctgccccgtgtgcaggcactgcgaccctgataatagggaccagcacaacagggaggcctttcactgcatcggctgcggctttagggggaatgccgacttggacgtcgccacccacaacatcgccatggttgccatcacaggggagtccttgaaaagggccaggggctccgtcgcttccaaaacaccccagccccttgccgccgag

SEQ ID NO: 126 - DNA, 2121 bp, Artificial
  synthetic
atggccgacactcccaccttgttcacccagtttctcagacaccatctccccggccaaaggtttaggaaagacatccttaagcaggctggcaggatcctcgccaacaaaggtgaggatgccaccatcgcatttctcagagggaaatccgaagagtcacctcccgacttccagccccccgtgaaatgtcccatcatcgcctgtagcagacccttgaccgagtggcccatctatcaggcctccgtcgccatacagggctacgtttacggccagagtctcgccgaattcgaggcctccgaccccggctgcagtaaggacggtctcctcggctggttcgacaagaccggcgtctgcaccgactactttagcgtccagggtctcaatctcatattccagaacgcaaggaagagatacatcggagtgcagaccaaggtgacaaacaggaatgaaaagagacataagaagctcaagagaattaatgctaagaggatcgccgaggggctccccgagctcacctccgacgagcccgagagtgccctcgacgagaccgggcacttgatcgatcctcccggcttgaataccaacatctactgctatcaacaggtcagtcccaaacccctcgccttgtcagaagtgaaccagctccccacagcctacgcaggctacagcaccagcggagacgaccctattcagcccatggtgacaaaggacaggctctcaatctccaaaggccagcccggatacatccccgagcaccagagggctcttctcagccagaagaaacacaggaggatgaggggttacggcctcaaggccagagccttgctcgtcatcgtgaggatccaggacgactgggccgtgatcgacctcaggagtttgctcagaaacgcctattggaggagaatagtgcaaaccaaggaaccctccacaataaccaagctcctcaagctcgttaccggcgaccccgttctcgatgccaccaggatggtggccaccttcacttacaagcccggaatcgtgcaggtcaggagcgccaagtgcctcaagaataaacagggctccaagctcttctccgagaggtatctcaatgagaccgtcagcgttacctccattgacctcgggagcaacaacctcgtggccgtcgctacatataggctcgtcaacggcaacacccccgagctcctccaaagattcacccttccttcccacctcgttaaggatttcgagagatacaagcaagcacacgacaccttggaagattcaatccagaagaccgccgtcgcctccctcccccagggccagcaaaccgagattaggatgtggagcatgtatgggttcagggaggcccaggagagggtctgccaggagctcggtctcgccgacggcagcataccctggaatgtcatgacagccactagtaccatccttactgacctcttcctcgccagaggcggcgaccctaagaagtgtatgttcaccagcgagcctaagaagaagaagaacagcaagcaagttctttacaaaatcagagacagggcctgggccaagatgtacaggaccctcctcagcaaggagaccagggaggcttggaataaggccttgtggggccttaaaaggggctcccccgactacgccaggctctccaaaaggaaggaggagctcgccagaagatgcgtcaactacaccatcagcaccgccgaaaagagggcccaatgcggtaggaccatcgttgcactcgaagacctcaacatcggctttttccacggcagggggaaacaagagcctgggtgggttgggctcttcaccaggaagaaggagaacaggtggcttatgcaggccctccacaaagccttcctcgagttggcccaccatagggggtaccatgttatcgaggtgaaccccgcctacaccagccagacctgtcccgtgtgcaggcactgtgatcccgacaacagggaccagcacaacagggaggccttccattgcatcggctgcgggttcagagggaacgccgatctcgacgttgctacccataatatagccatggtcgccatcaccggcgaaagcctcaagagggctaggggcagtgtggccagcaagacaccccagcccttggcagccgag

SEQ ID NO: 127 - DNA, 2121 bp, Artificial
  synthetic
atggccgacacccctacccttttcacccagttcctcaggcaccacctccccggccagaggttcaggaaggacatccttaagcaggccggaagaatcctcgcaaacaagggtgaggacgccactatcgcattcctcaggggcaagtctgaggagagccctcccgacttccagcctcccgtcaagtgccctatcatcgcctgtagcaggccccttacagaatggcccatataccaagccagcgtcgcaatccaggggtatgtctacggccagtccctcgccgagtttgaagcctccgaccccggctgttcaaaggatggcctcctcggctggttcgacaaaaccggagtgtgcacagactatttcagcgtgcaggggttgaacctcatcttccaaaacgccaggaaaaggtacatcggagtccagaccaaggtgacaaacaggaacgagaagaggcacaagaagctcaagaggatcaatgctaagaggatcgccgaagggctccctgagctcacctccgacgagcctgagagcgccctcgacgagaccggccatcttatcgacccacccggtttgaacaccaacatctactgctatcagcaggtctctcccaagccactcgccctctccgaggtcaaccaactccctaccgcctacgccggctactccacatccggtgatgaccccatccagcccatggtcaccaaagacaggctctccatcagcaaaggacaacctggatacatccccgagcaccagagggccctcctcagtcagaagaagcataggaggatgaggggatatggcctcaaggcaagggccctcctcgtgatcgttaggatccaggacgactgggcagtgatcgacctcaggtccctcctcaggaatgcctactggaggagaattgtccaaaccaaagaaccctccaccatcaccaaactcctcaagctcgtcaccggcgaccccgtcctcgacgccaccagaatggttgccacctttacctacaagcccggtatcgtccaggtcaggtccgccaaatgcctcaagaacaagcagggatccaaactcttcagcgagagatatctcaacgagaccgtgtccgttacctccatcgatctcgggagtaataatctcgtggccgtcgcaacctataggctcgtgaacgggaacacacccgaactccttcagaggttcaccctcccctcccacctcgtcaaggacttcgagaggtataaacaggcccacgatacccttgaggatagcatccagaagaccgccgtggccagtctcccacaggggcagcaaaccgaaattaggatgtggagcatgtacggcttcagggaggcccaggagagggtctgccaggaattgggtctcgccgacggctccatcccctggaacgttatgactgcaaccagcaccatcttgaccgacctcttcctcgcaagaggtggggaccctaagaagtgcatgtttactagcgagcccaagaagaagaagaactccaagcaggttctctacaagatcagggatagggcctgggccaagatgtacaggaccttgctctccaaagagaccagggaggcctggaacaaggctctctggggcctcaaaaggggcagccccgactacgccaggctctccaagagaaaggaggaactcgccaggaggtgcgttaactacacaatcagcaccgccgagaagagggcccagtgcgggaggacaatcgtcgccctcgaggacctcaatatcggtttcttccacggaaggggcaagcaggagcctgggtgggtgggcctcttcaccaggaaaaaggagaacagatggctcatgcaggcactccataaggccttcctcgaattggcccaccacaggggctatcacgtcatcgaagtgaacccagcatacaccagtcagacctgtcccgtctgcagacactgcgaccccgacaacagggatcagcacaacagggaagccttccactgcatcggatgcggcttcaggggtaatgccgatctcgatgttgccacccataacattgccatggtcgccattaccggggagtccctcaaaagagcaagggggagtgttgcaagcaaaactccccaacccctcgccgccgag

SEQ ID NO: 128 - DNA, 2121 bp, Artificial
  synthetic
atggccgacacccccaccttgttcactcagttcctcaggcatcacttgcccgggcagaggttcagaaaggacatcctcaagcaggccggaaggatcctcgccaacaagggcgaggatgccaccatcgctttcctcagggggaaaagcgaggagagtccccccgacttccagccccccgtgaagtgccccatcatcgcctgcagcagacccttgaccgagtggcccatctaccaggccagtgtcgccatccagggctatgtgtacgggcagagcctcgccgagtttgaagcctccgaccccgggtgcagcaaggacggtctcctcgggtggttcgacaagaccggggtgtgcaccgattacttctccgtgcaggggctcaacttgatcttccagaatgccagaaagaggtatatcggtgttcagaccaaggtcaccaataggaacgagaagaggcacaagaagctcaagagaatcaacgccaagaggatcgccgaaggtctccccgagctcaccagcgacgagcccgagagcgccttggacgaaaccgggcacttgatcgacccccccgggctcaacacaaatatatactgttaccaacaggtttcacccaagcccctcgccctttccgaggtcaaccagctccctaccgcctacgccggctactcaacttccggagatgatcccatccagcccatggtgaccaaggataggttgtccattagcaagggccagcccggctatatacccgagcaccaaagggccctcctctcacagaagaagcacagaaggatgagggggtacggcctcaaggccagggccctccttgtcattgtcaggatccaagacgactgggccgtcatcgacctcagaagtctcctcaggaacgcctactggaggaggatcgttcagactaaggagcccagcacaataaccaaactcctcaagctcgtgaccggcgaccccgttctcgacgcaaccagaatggtggcaaccttcacatacaagcccggcatcgtccaggttaggtcagccaagtgtctcaagaacaagcaaggaagcaagttgttctctgagaggtaccttaatgagactgtgtccgtgacctccatagacctcgggtccaacaacctcgtggccgtggccacatacaggctcgtcaacgggaacacccccgagctccttcagaggttcaccctccccagtcacctcgtcaaggacttcgagaggtacaagcaggcccacgataccctcgaggactctatccagaagaccgccgtggcctccctcccccagggccaacaaaccgagataaggatgtggagcatgtacggtttcagggaagcccaggaaagggtgtgccaagagctcggcctcgccgacgggagcatcccctggaacgtcatgaccgccacctccaccatcctcaccgacctcttcttggcaagagggggggaccccaagaagtgcatgtttaccagcgagcccaagaagaagaagaattccaagcaggttctctacaagattagggacagagcctgggctaaaatgtacaggactcttctctccaaggagaccagggaggcctggaacaaggccctctggggattgaaaagaggtagccccgattatgccagactctcaaagaggaaggaagagctcgccagaaggtgtgtcaactacaccatcagcacagccgagaaaagggcccaatgcggtagaactatagtcgccctcgaagacctcaacatcgggttcttccacggtaggggcaagcaggagcccggctgggttggcttgttcaccagaaagaaggaaaacagatggctcatgcaagcactccataaggccttcctcgagctcgcccatcacagagggtatcacgtgatcgaggtcaatccagcttacactagccagacctgccccgtgtgcaggcactgtgaccccgacaacagggatcaacacaatagggaagctttccactgcatagggtgcgggttcagggggaacgccgacctcgatgtggccactcataacatcgccatggtcgccatcaccggggagtccctcaaaagagccagagggagtgttgcctccaagaccccccagcctctcgccgccgaa

SEQ ID NO: 129 - DNA, 2121 bp, Artificial
  synthetic
atggccgacaccccaaccctcttcacacagttccttaggcaccacctccccggccagaggttcaggaaggacatcctcaagcaggcaggtaggatcctcgccaataagggggaggacgccactatagccttcctcagaggcaagtccgaggaaagcccccccgacttccagccccccgtcaagtgccccatcattgcctgtagcagacccctcaccgagtggcctatctaccaggctagcgtcgccatccagggttacgtctacggccagagcctcgccgagttcgaggcctccgaccccgggtgctcaaaagatggactcctcgggtggttcgataagaccggggtgtgcaccgactacttttctgtgcagggcctcaacctcatcttccagaacgccaggaaaaggtatatcggcgtgcaaaccaaagtgacaaataggaacgagaaaaggcacaaaaagcttaagaggatcaatgccaaaagaattgccgagggcctccccgagctcaccagcgacgagcccgagagcgccttggacgagaccgggcacctcattgacccccccggcctcaacaccaacatctattgctaccagcaggtgtcccccaagccccttgccctcagcgaggttaaccagttgcccaccgcttacgctgggtactcaaccagtggtgacgacccaatacagcccatggttaccaaggatagactctccatctccaagggccagcccggctacatcccagagcatcagagagccctccttagtcagaaaaagcacaggagaatgagggggtatggcctcaaagccagagccctcctcgtgatagttaggatccaggacgactgggccgttatagacctcaggtccctcctcaggaacgcctactggagaagaatcgtccaaaccaaggagcccagcaccatcaccaagctcctcaagctcgtgaccggggatcccgttctcgacgccaccaggatggtcgcaaccttcacctacaaacccgggatcgttcaggttaggagcgccaagtgcctcaaaaataagcaaggaagtaagctcttctcagaaaggtacttgaatgagaccgtgagcgtcacctccatcgatctcgggtctaacaacctcgtggctgtcgccacctataggctcgtcaatggcaacacccccgagctcctccaaaggttcaccctcccttcccatctcgttaaggactttgagaggtataagcaggcccacgacaccttggaggacagcatccagaagaccgccgtggcctccctcccccaggggcagcagacagagatcagaatgtggtccatgtacggcttcagagaggcccaagagagggtgtgccaagagctcgggctcgccgacggctctatcccctggaacgtgatgaccgccacttcaaccatcttgaccgacctcttcctcgcacggggaggggatcccaagaaatgtatgttcacctccgagcccaaaaagaaaaagaattccaagcaggtgctttacaagatcagggacagggcctgggcaaagatgtataggaccctcctctcaaaggaaaccagggaggcttggaataaggccctctggggcctcaagaggggatcccccgactacgccaggctcagcaaaaggaaagaggagctcgccaggaggtgcgtgaactacacaatttccaccgctgagaagagggcccaatgcggcagaaccatcgttgcccttgaagacctcaacatcgggttcttccacggcaggggaaagcaggagccaggttgggtcgggctcttcacaaggaaaaaagaaaacagatggctcatgcaagcccttcacaaggccttcctcgagctcgcacaccacaggggatatcacgtgatcgaagtgaaccccgcttacacctcccagacctgccctgtctgcagacactgtgaccccgacaacagagaccagcataatagggaagccttccactgcatcggctgtgggtttaggggtaacgctgacctcgacgtcgctactcacaacatcgccatggtggccatcacaggggagtctttgaagagggccagaggcagcgtggccagtaagactccccagccacttgccgcagag

SEQ ID NO: 130 - DNA, 2121 bp, Artificial
  synthetic
atggcagacacacccacactttttacccagtttctcaggcaccacttgcccggacagagatttaggaaggacatcctcaagcaagccggcaggatcttggccaacaagggggaggacgccactatcgcattcctcagggggaaatccgaggaatcaccccctgacttccagcccccagtcaaatgtccaatcattgcctgtagcaggcctttgactgaatggcccatataccaggcatctgtggccatccaaggctacgtgtatggccagagcctcgctgagttcgaagctagtgaccctggatgctctaaggacgggctcctcggctggttcgacaagactggtgtgtgcacagattacttcagcgttcagggactcaatctcatcttccagaacgccaggaagaggtacatcggggtgcagaccaaggtgaccaacaggaacgagaagaggcacaagaagctcaagaggatcaatgccaagaggatcgctgagggtctccctgagctcacctccgacgagccagagtccgccctcgatgagaccggacacttgattgacccccccgggctcaataccaacatctattgctaccaacaagtgagccccaagcccctcgccctctccgaagtgaaccagctccccaccgcctacgcaggctactccaccagcggggacgaccccattcagcctatggtgaccaaggataggttgagcatttctaaggggcagccaggctacatccctgagcaccagagggcccttctctcccagaagaaacacaggaggatgagggggtacgggttgaaggcaagagcactcctcgtgattgttagaattcaggacgactgggccgtcatcgacctcagaagcctcctcagaaacgcctattggaggagaatcgtccaaaccaaggagcccagcaccatcactaaacttctcaagctcgttaccggtgaccccgtgctcgatgcaaccaggatggtggccaccttcacctacaagcccgggatcgtccaggtgaggagcgcaaaatgtctcaaaaacaagcaggggtccaagctcttttctgagagatacctcaacgagaccgtgtccgtgacctcaatcgatctcgggagcaataacctcgtcgccgttgcaacctacagactcgtgaacgggaacacccccgagctcttgcagaggttcacccttcccagtcacttggtcaaagattttgagaggtacaaacaggcccatgacaccctcgaggattcaatccagaagaccgcagtcgcctccctcccccagggacagcaaaccgagatcaggatgtggagcatgtacgggttcagggaagcccaggagagggtgtgtcaagagcttgggctcgccgacggctccatcccatggaatgtgatgaccgccacctcaaccatcctcaccgacctctttctcgccagggggggtgaccccaagaagtgcatgtttacttccgagccaaagaagaagaaaaactccaagcaggtgttgtataaaataagggacagggcctgggccaagatgtacaggaccctcctctccaaggagaccagggaggcctggaacaaggccctctggggcctcaaaaggggcagccccgactacgccagactctccaagaggaaggaagagctcgcccggaggtgcgtcaactataccattagcactgccgagaagagggcccagtgcggcaggaccatcgtggccttggaggatctcaacatcggcttcttccacgggaggggcaaacaggagcccgggtgggtgggcttgtttaccaggaagaaagaaaataggtggcttatgcaggccctccacaaggccttcctcgagctcgcacaccacaggggctatcacgttatcgaggtcaaccccgcctataccagccagacctgcccagtctgcaggcactgcgaccccgacaacagggaccagcacaatagggaggctttccattgcatcgggtgcggatttaggggcaacgccgacctcgatgtggctacacacaatatcgccatggttgctatcaccggcgagagtctcaaaagggccaggggatcagtcgcctctaagaccccccagcccctcgccgccgag

SEQ ID NO: 131 - DNA, 2121 bp, Artificial
  synthetic
atggccgacacccccacccttttcacacagtttttgaggcaccacctccccggacagaggttcaggaaggacattctcaagcaagccgggaggatcctcgccaacaaaggggaggacgccaccatcgccttcttgagaggtaagagcgaggagtccccccccgatttccaaccccccgtgaagtgtcccatcatcgcctgctccaggcccctcaccgagtggcccatctaccaggcctctgtcgctatccagggatatgtttacgggcagagtcttgcagagttcgaggccagcgaccccggatgtagtaaggacggcctcctcggttggttcgacaagactggcgtctgcaccgactattttagcgttcaggggctcaatctcatcttccagaacgccagaaagaggtacatcggcgtccaaactaaggtgactaataggaacgagaagaggcacaagaagctcaaaagaatcaacgccaagagaatcgctgagggcctccccgagctcaccagcgacgagcccgagtccgcactcgacgagaccggccatctcatcgacccccccgggctcaacacaaacatctactgctatcaacaagtctcccccaaacccctcgccttgtccgaggtgaaccaacttcccacagcatacgctggctacagcacctccggcgacgaccccatccagccaatggtgaccaaagacagactctcaatcagcaagggccagcccggatacatccctgagcaccagagggccctcctctcccagaagaagcacaggaggatgaggggttatggactcaaggctagggccctcctcgtgattgtgaggatccaggacgactgggcagttattgatctcaggagcctccttaggaatgcctactggagaaggattgttcaaaccaaggagcctagcaccatcaccaagctcctcaagctcgtgaccggggatcccgtcctcgacgccaccagaatggtggccaccttcacctacaaacctggcattgtgcaggtcaggtctgccaaatgcttgaagaacaagcaggggtccaaactcttcagcgagaggtacctcaacgagaccgtttccgtcacctcaatcgatttggggtccaacaacctcgtcgccgtcgccacctataggctcgtgaatggcaacaccccagaattgcttcagaggttcacactcccttcccaccttgttaaagactttgaaagatacaagcaagcccacgacacactcgaggacagcatccaaaagaccgccgtcgcctctctcccccaaggacaacagaccgagataaggatgtggagcatgtatgggttcagggaggcccaggaaagggtttgccaggagctcggtttggcagacggctccattccctggaacgtgatgaccgccacctccaccatcctcacagacttgtttctcgccaggggaggagaccctaagaagtgtatgttcacctcagagcctaagaaaaagaaaaactccaagcaggtcctctacaagatcagggacagggcctgggccaagatgtataggactctcctctccaaggagaccagggaggcatggaacaaggccctctggggccttaagaggggatcccccgattatgccaggctcagcaagaggaaggaggagctcgccaggagatgcgttaattatactatatctaccgccgaaaagagggcccaatgcgggaggaccatcgtggccctcgaggacctcaatatcgggttctttcacggcaggggtaagcaggaacccgggtgggtgggccttttcaccaggaagaaggaaaacaggtggctcatgcaagccctccacaaggccttcctcgagttggcccaccacaggggataccacgtcatcgaggttaatcccgcctacacctctcagacctgccccgtgtgcagacactgcgatcccgacaacagggatcagcacaacagggaagcctttcactgcatcgggtgtgggttcaggggtaacgccgacctcgatgtcgcaacccacaatatcgccatggtggctatcaccggggagagcctcaagagggccagaggaagcgttgcctcaaaaacaccccagcccctcgccgccgaa

SEQ ID NO: 132 - protein, 757 aa, Unknown
  bacteriophage
MPKPAVESEFSKVLKKHFPGERFRSSYMKRGGKILAAQGEEAVVAYLQGKSEEEPPNFQPPAKCHVVTKSRDFAEWPIMKASEAIQRYIYALSTTERAACKPGKSSESHAAWFAATGVSNHGYSHVQGLNLIFDHTLGRYDGVLKKVQLRNEKARARLESINASRADEGLPEIKAEEEEVATNETGHLLQPPGINPSFYVYQTISPQAYRPRDEIVLPPEYAGYVRDPNAPIPLGVVRNRCDIQKGCPGYIPEWQREAGTAISPKTGKAVTVPGLSPKKNKRMRRYWRSEKEKAQDALLVTVRIGTDWVVIDVRGLLRNARWRTIAPKDISLNALLDLFTGDPVIDVRRNIVTFTYTLDACGTYARKWTLKGKQTKATLDKLTATQTVALVAIDLGQTNPISAGISRVTQENGALQCEPLDRFTLPDDLLKDISAYRIAWDRNEEELRARSVEALPEAQQAEVRALDGVSKETARTQLCADFGLDPKRLPWDKMSSNTTFISEALLSNSVSRDQVFFTPAPKKGAKKKAPVEVMRKDRTWARAYKPRLSVEAQKLKNEALWALKRTSPEYLKLSRRKEELCRRSINYVIEKTRRRTQCQIVIPVIEDLNVRFFHGSGKRLPGWDNFFTAKKENRWFIQGLHKAFSDLRTHRSFYVFEVRPERTSITCPKCGHCEVGNRDGEAFQCLSCGKTCNADLDVATHNLTQVALTGKTMPKREEPRDAQGTAPARKTKKASKSKAPPAEREDQTPAQEPSQTS

SEQ ID NO: 133 - DNA, 2271 bp, Artificial
  synthetic
atgcctaagcccgctgtggagtctgaattcagcaaggttctgaaaaaacactttcctggtgaacgttttagatccagttacatgaagcgcggtggaaaaatcttggcagcccagggggaggaagcagtagtcgcatacctacaaggtaagtccgaggaggagccgcctaatttccaaccaccagccaagtgtcatgtggtgacaaaaagtagagacttcgctgaatggcctattatgaaagcaagcgaggcaatccagaggtatatttatgcgttgagcaccaccgaacgcgctgcatgcaaacctggcaagtcctcggagtcccacgccgcctggtttgctgctacgggggtttctaatcacgggtattcacatgtacaaggactgaatttgattttcgatcacactttgggaagatacgatggtgtccttaaaaaggtccaactgagaaatgagaaggccagggcacgccttgagtctataaacgcttcacgcgcggatgaaggactgcctgagataaaggctgaagaagaggaagttgctaccaacgagacgggacacttgttgcaacctccggggatcaatccttcattctatgtttaccaaacgatatctcctcaagcttacagaccacgtgacgaaatagtgttaccccctgaatatgccggttatgttagagatccaaacgcaccaatccctctaggagttgttagaaacaggtgtgatattcaaaagggatgtccaggttatataccagagtggcagagagaggctggcactgcgattagtcctaaaactggcaaagcggtgacggttcctgggttgagtccaaaaaagaacaagcgcatgcgccgctattggagaagtgaaaaggagaaagcccaggatgcattgcttgtgactgtcaggattggcactgattgggtcgtaattgatgtgagaggtctgttgcgtaacgcgcgatggagaacaattgctcctaaggatatctcgctcaatgccctgctcgacttgttcactggagatcccgtcatagacgtcaggaggaatatagttacattcacatacacactggacgcctgcggtacttacgcacgtaagtggactcttaaagggaagcaaaccaaagctactttggacaaattgacggcaacacagacagtcgcattggtggccatcgatttgggccaaacaaatcctatttctgctggaatctcgagggtgacacaagagaacggtgccctccagtgtgaacccttagaccggttcactcttccagacgatcttctgaaggacattagtgcttacagaattgcttgggataggaacgaagaagagttgagggctagaagtgtggaggctctgcccgaagcacagcaggccgaagtcagagctctcgatggagtgtcaaaggaaaccgcgagaacacagctctgcgcagattttggccttgaccccaagaggttgccctgggacaagatgtcctccaacacaactttcattagcgaggcactgttgtcaaacagcgtttcccgcgatcaggtattttttactcctgccccaaagaaaggagcaaagaagaaggctcctgttgaggttatgcgcaaggacaggacctgggcgagggcttacaagccaaggctaagcgtggaagcacagaagcttaagaatgaagcgctttgggctctgaagaggacttcaccagagtaccttaagctctcaagacgaaaagaagaattgtgtcggaggagcataaattatgttatcgaaaagactcggagaagaactcagtgtcagatcgttattcccgtgatagaggatttgaatgttcgatttttccatggctcaggcaagagattgcctggttgggataattttttcactgctaagaaggaaaaccgttggttcatacaaggtttgcataaggccttctcagacttgcgtacccaccgctcgttctacgtttttgaggtgagaccagaacgtacttcaattacttgtcctaaatgcggccattgcgaggttggaaacagagatggtgaagcattccaatgtctgtcgtgcgggaaaacctgtaatgcagaccttgacgttgcaacgcacaatcttacacaggtagctcttactgggaagaccatgcctaagagggaagaaccacgcgatgctcaaggaactgctcctgcaagaaagacaaaaaaagcttctaagtcaaaggctccacctgcagaaagggaagaccagacccctgcccaggagccatctcagacatca

SEQ ID NO: 134 - DNA, 2271 bp, Artificial
  synthetic
atgcctaagcccgccgttgagtctgaattttccaaggttctcaagaagcattttcccggagagaggtttagaagcagctacatgaagagaggggggaaaatcctcgcagcccagggggaggaagctgtggtcgcttacctccaaggcaagagcgaagaagagccccccaacttccagcccccagccaaatgtcatgtggttacaaagtctagggactttgccgaatggccaataatgaaggccagcgaggccatccagaggtacatctatgccctcagcaccaccgagagagccgcctgcaagcccggaaagtcaagcgagtcacacgctgcctggttcgccgccaccggcgtttcaaaccacgggtattctcatgtccagggccttaaccttatcttcgaccacaccctcggcaggtatgacggagtcctcaagaaagttcaactcaggaacgagaaggctagggccaggctcgagagcatcaatgcctctagggcagatgaaggcctccccgagatcaaggccgaggaggaggaggtggccaccaacgagaccggtcacctcctccaacctcccggcatcaatccaagcttctatgtgtaccagaccatcagcccccaggcctataggcccagggacgagatcgtcctcccccccgagtacgccggatacgtcagggaccctaatgccccaatccctctcggtgtggtgaggaataggtgcgacatccaaaaggggtgccccggctacatcccagaatggcagagggaggccggaaccgccatctcccccaagaccggtaaggccgtcaccgtccccgggctcagtcccaagaagaacaagaggatgaggagatactggaggagcgagaaggaaaaggcccaggatgcactcctcgttaccgtcaggatcggcaccgactgggtggtcatcgacgtgagaggcctcctcaggaacgccagatggaggaccatcgcccccaaggatatcagcctcaacgccctcctcgatctcttcactggagaccccgtcatagacgttaggagaaacatcgtcaccttcacctacaccctcgacgcctgcggaacctacgctagaaagtggaccttgaaagggaaacagaccaaggccacccttgacaaactcactgccacccagactgttgccctcgtggccatcgacctcggccagaccaaccccatctcagccggcatctcaagggtgacacaggagaatggcgccctccagtgcgagcctctcgacagattcacactccccgacgacttgctcaaggacatcagcgcatacaggatcgcctgggacaggaacgaagaagaacttagggcaagatccgtcgaggccctccctgaagcacagcaagccgaggtgagggccctcgacggggtgagcaaggagaccgccaggacccagctctgtgccgatttcgggctcgatcccaagagacttccttgggacaagatgagcagtaacaccaccttcatttccgaagccctcctcagcaacagcgttagcagagaccaggtcttcttcactcccgcccccaagaaaggcgccaagaaaaaagcccccgtggaggtcatgaggaaggacaggacctgggcaagagcctacaagcccaggctctcagttgaagcccagaaattgaaaaacgaagccctctgggctctcaagaggacctcccccgaataccttaaattgagcaggaggaaggaggagctctgcaggaggtccataaactacgtgatcgaaaaaactagaaggaggacacaatgtcagatcgttatccccgttatcgaagatctcaacgtgaggttcttccacggctcagggaagaggctcccaggatgggataacttcttcaccgccaagaaggagaataggtggttcattcagggattgcacaaggcattcagtgatctcaggactcacagaagcttttatgtgttcgaggtgaggcccgagaggacctccatcacctgccccaagtgcgggcattgcgaggtcggcaacagggacggggaggcattccagtgcctctcctgcggcaaaacttgcaacgccgacctcgacgtggcaacacataacctcacccaagtcgctctcacagggaagaccatgcccaagagggaggaacccagagacgcccagggtaccgcacccgccaggaagaccaagaaggccagcaaaagcaaggcaccccccgccgagagggaggatcagacccccgctcaggagccctcacagacctcc

SEQ ID NO: 135 - DNA, 2271 bp, Artificial
  synthetic
atgcccaagcccgcagtcgagagcgagttttcaaaggttctcaaaaagcactttcccggcgagaggttcagatccagctatatgaaaagaggggggaaaatcctcgccgcccagggcgaagaggccgttgtggcctacttgcagggcaagagcgaagaagaaccccccaacttccagcctcccgccaagtgccacgtcgtgacaaagagcagagacttcgccgagtggcccatcatgaaggcttccgaggccatccagaggtacatctacgccctctccaccacagagagggccgcctgcaagcccggcaagagcagcgagtcccacgccgcctggtttgctgccaccggcgttagcaatcatgggtactcccacgtccaggggcttaatctcattttcgaccacaccctcgggaggtacgacggtgtgctcaaaaaggttcagctcaggaacgagaaggcaagggctaggctcgaatcaatcaacgccagtagagctgatgagggtctacccgagattaaagccgaagaggaggaggtcgccaccaatgagactggtcacctcctccagccacccggtatcaatcccagtttctacgtgtaccaaaccatctccccacaggcttacaggcccagagatgagatcgtcctcccacccgagtacgccgggtacgttagagaccccaacgcccccatccccctcggtgtggtgaggaacaggtgcgatatccagaaggggtgccccgggtacatccccgaatggcagagggaggccgggaccgccatcagccccaaaaccggcaaggccgttactgtgcccggactctctcccaaaaagaacaagagaatgaggaggtactggaggagcgaaaaggagaaggcccaggacgccttgctcgtcactgtcagaatcgggaccgactgggtggtgatcgacgtgaggggcctcctcaggaacgccaggtggaggacaatcgcccccaaggacatctccctcaatgccctcttggacctcttcaccggcgatccagttatcgatgtcaggaggaacatcgtgaccttcacatataccctcgacgcctgtggtacctacgccagaaagtggaccctcaaggggaaacagaccaaggctaccctcgacaagctcaccgccacccagaccgtggccttggtcgcaatcgacctcggacagaccaaccccatcagcgccgggatctctagggtgacccaagagaacggggccttgcagtgtgagcccctcgacaggttcaccctccccgacgaccttcttaaggatattagcgcttacagaatcgcctgggacaggaacgaggaggagctcagggccagaagcgtcgaggccctccccgaagcccagcaggccgaagtcagggccctcgacggcgtgagcaaggagaccgccaggacccaactttgtgctgacttcggccttgaccccaagaggctcccctgggacaaaatgtcatccaacaccaccttcatctctgaggccctcctcagcaatagcgtgtccagagaccaggtctttttcacccccgcccccaagaagggagccaagaagaaggcccccgtggaggttatgaggaaagacaggacctgggccagggcctacaagccaaggctcagcgtcgaggcccaaaaactcaagaacgaggctctctgggcactcaaaagaacctcccccgagtaccttaagctcagcaggaggaaggaggagctctgtaggaggtctattaactacgtgatcgagaagaccaggaggaggacacagtgccagatcgttatccccgtgatcgaggatctcaacgtgaggttcttccacgggagcgggaagaggctccccggctgggacaacttcttcaccgccaaaaaagagaacaggtggttcatacaagggctccataaggcctttagcgacctcaggacccacaggagcttttacgtcttcgaggtgaggcccgagaggaccagcattacttgtcctaagtgcgggcactgtgaggtcgggaacagggatggggaagcattccagtgcttgtcctgcgggaagacctgcaatgccgacttggacgtcgccacccacaacctcacccaagtggccctcaccggaaagaccatgcccaagagggaggaacctagggacgcccaagggaccgcccccgctagaaagacaaagaaggcctccaaatccaaggcaccccccgccgagagggaagaccaaaccccagcccaagagccctcccagaccagc

SEQ ID NO: 136 - DNA, 2271 bp, Artificial
  synthetic
atgcccaaacctgccgtggagagcgagtttagcaaggttctcaagaagcacttcccaggtgagaggttcaggagctcatacatgaagaggggggggaagatactcgcagcccagggggaggaagccgtggttgcctacctccaggggaagtcagaagaggagcctcccaattttcagccccccgccaagtgccacgtggtgacaaagagtagggacttcgccgagtggcccatcatgaaagccagtgaggctattcagaggtatatctacgcactctctaccaccgagagggccgcctgtaagcccgggaagagctcagagtcccatgccgcctggttcgccgccacaggggtttctaaccacgggtatagccacgttcaaggtctcaacttgatttttgaccacaccctcggtagatacgacggagttcttaaaaaggttcaactcagaaacgagaaagccagggccaggctcgagagtatcaacgcctccagggccgatgaaggcctccccgagatcaaggcagaggaggaagaagtcgccaccaacgagaccggtcatcttctccagccccctgggatcaaccccagcttctacgtctaccaaactatcagccctcaggcctataggcccagggacgagatcgtgctcccccctgagtacgccggatacgtcagggaccccaacgctcccatccccctcggggttgtgaggaacaggtgcgacatccagaaggggtgccccgggtacatccccgagtggcagagggaggccgggacagccatctccccaaagaccggcaaagccgtgacagttccaggcctctcacctaaaaagaacaagaggatgaggaggtactggagatcagagaaagaaaaggcccaagatgccctcctcgtcaccgttaggattggcactgactgggttgtcatcgacgtgaggggcctcctcaggaatgccagatggagaactatcgcccccaaagacatctccctcaacgccctcttggacctcttcaccggggaccccgtgatcgacgtgaggaggaacatcgtgaccttcacctacaccttggacgcctgcgggacttacgccaggaagtggaccctcaaaggcaagcagactaaggccacccttgacaagctcaccgccacccagaccgttgccctcgtcgcaatcgaccttgggcagaccaaccccatcagcgcagggatctctagggtgacccaggagaatggcgcccttcagtgcgagcccttggacagattcaccctccccgacgacctcctcaaggacatctcagcctacaggatagcctgggacaggaacgaggaggagctcagagccagatccgtcgaagccctccccgaggcccagcaagccgaggtgagggccctcgacggtgtctccaaggaaaccgccaggacccagctctgcgccgacttcggcctcgaccccaaaagactcccctgggacaagatgtccagcaacaccactttcatttccgaggccttgctcagcaacagcgttagcagagaccaagtgttcttcacccccgctcccaaaaagggagccaagaagaaagcccccgtcgaggttatgaggaaagacagaacctgggccagggcctacaagcccaggctcagcgtcgaggcacagaaactcaagaatgaagccctctgggctctcaagagaacaagccccgagtacttgaaactcagcagaaggaaggaggaactctgcaggaggtccatcaattacgtgatcgagaagactaggaggaggacccagtgccagatagttatccctgttatcgaagaccttaacgtgaggttctttcacggcagcgggaagaggcttcccgggtgggacaactttttcaccgccaaaaaggaaaacaggtggtttatccagggcctccacaaggccttctcagacctcaggacccacaggtccttctacgttttcgaggtgagacccgagaggaccagcatcacctgccccaagtgcgggcactgcgaggtcggcaatagggacggggaggctttccaatgcttgagttgcgggaagacctgcaatgccgacctcgacgttgccactcacaacttgacccaagtggctctcaccgggaaaaccatgcccaagagggaagaacccagagacgctcaggggaccgctcccgccagaaaaaccaagaaggcctcaaagtccaaggctccccccgccgaaagggaggaccaaacccccgctcaggagccttcccagacatcc

SEQ ID NO: 137 - DNA, 2271 bp, Artificial
  synthetic
atgcccaagcccgccgtcgagtccgagttctcaaaggtcctcaagaagcacttccccggggagagattcaggagctcttacatgaagagggggggtaaaatcctcgcagcccagggcgaggaggccgtggtcgcctacttgcaggggaagtcagaggaggaaccccccaattttcagccccccgccaagtgccacgtcgtgacaaagtccagggactttgctgaatggcccatcatgaaagcctccgaggctatccagaggtacatatacgccctctccaccaccgagagggccgcctgtaagcccgggaagagcagcgagtcccatgccgcctggttcgctgccaccggggtttccaaccacggctactcccacgttcagggactcaatctcatctttgaccacacactcggcagatacgacggcgttctcaagaaggtccagctcaggaatgagaaggccagggccaggctcgagtccatcaacgcaagcagagccgacgagggactccccgagatcaaggccgaggaggaggaagttgccaccaacgagaccgggcacctcctccaaccacctgggataaacccatccttctacgtgtaccaaaccatcagcccccaggcttacaggcccagagatgagatcgtgttgccccccgagtatgccggatacgttagggaccccaatgcccctatccccctcggcgtcgtcaggaacagatgcgacatccagaaaggatgccccggctacatccccgaatggcagagagaggccggcaccgcaatctcccccaagaccggcaaagccgtgaccgttcccggcctcagcccaaagaaaaacaaaaggatgagaagatactggaggagtgagaaggagaaagctcaagatgccctccttgtcactgtcaggatcgggaccgactgggtcgtgattgacgtgaggggactccttaggaacgccaggtggagaaccatcgcccccaaggacatatccctcaacgccctcttggacctcttcaccggtgacccagtgatcgacgtcagaaggaatatcgtgacctttacctacaccttggacgcctgcgggacatatgccaggaagtggaccttgaaggggaagcagaccaaggctactctcgacaaactcaccgccacccagaccgttgccctcgtcgccatagacctcggccagaccaaccccatcagcgccggcatctctagagtaactcaggaaaatggggccctccagtgtgagcccctcgacagattcaccctccccgacgatctcttgaaggacatttccgcctacaggatcgcctgggacaggaacgaggaggagctcagggccagatcagtggaagcacttcccgaggcccagcaggcagaagtgagggccctcgacggggtgagcaaagagacagccaggacccagctttgtgccgatttcggactcgaccccaagagactcccctgggacaagatgtccagcaatacaaccttcatcagcgaggcccttctctctaacagcgtcagtagagaccaagtcttcttcactcccgcccccaagaagggagccaagaagaaggccccagtggaggtcatgaggaaggataggacctgggccagagcttacaagcccaggctttccgtggaggcccagaagttgaaaaatgaggcactctgggccctcaagagaaccagccccgagtacttgaagctctccaggaggaaggaggaactctgcaggaggtccatcaactacgtcatagagaagaccagaagaaggacccagtgtcagatcgtcatccctgtcatcgaggatcttaacgtcagattcttccacgggtccggtaagaggttgcctggctgggacaacttcttcaccgcaaagaaggagaacaggtggtttatccaaggcctccacaaggcctttagcgatctcagaacccacagaagcttttacgtgttcgaggtcaggcccgagagaaccagcatcacctgtccaaagtgcgggcactgcgaagttgggaatagggacggggaggctttccagtgcctctcctgcgggaaaacttgcaacgccgacttggacgtcgcaacacataacctcacccaggtggccctcaccggaaagaccatgcccaagagagaggagcctagggacgcccaaggtactgcccccgccagaaaaaccaaaaaggccagcaagtccaaggccccccccgccgaaagggaggaccagacccccgctcaggaacccagccaaacctcc

SEQ ID NO: 138 - DNA, 2271 bp, Artificial
  synthetic
atgcccaagcccgccgtcgaatcagagttcagcaaagttcttaaaaaacactttcccggtgaaaggttcagaagttcatacatgaagagggggggtaagatcctcgccgcacagggcgaggaggcagtcgtcgcttacctccagggaaaatccgaggaggagccccccaactttcaaccacccgctaaatgtcacgtcgtgaccaagtccagggactttgcagaatggcccatcatgaaagccagcgaggccatccagaggtatatctacgctttgagtactaccgaaagggcagcctgcaaacctgggaaaagcagcgagtcacacgccgcctggttcgccgcaaccggagtcagcaaccacgggtactcccacgtgcagggcctcaacctcattttcgatcacaccctcggaaggtatgacggggttctcaaaaaagtgcagctcaggaacgaaaaagccagggcaaggttggagtccatcaacgccagtagggccgacgagggcctccccgagatcaaggcagaggaagaggaagtcgccaccaacgagacaggccaccttctccaaccccccgggataaacccaagtttttacgtgtaccagaccatctcaccccaagcctacaggcccagggatgagatcgttctccctcccgagtatgccgggtatgtaagggatcccaacgccccaatccccctcggcgtggtgaggaacaggtgcgacatccagaagggatgccccggatatatccccgagtggcagagggaggccgggaccgccatcagtcccaaaacaggcaaagccgtgaccgtccccgggctcagccccaaaaagaacaagaggatgaggagatattggagaagcgagaaggagaaggcccaagacgccctcctcgtgaccgtcagaatcggcaccgactgggtggttatcgatgttaggggactcctcaggaacgccaggtggaggaccatcgcccccaaggacatctccctcaacgccctcttagacttgttcaccggcgaccccgttattgacgtcaggaggaacattgttaccttcacttataccctcgacgcttgcgggacctacgccaggaagtggacccttaagggaaagcagaccaaggccaccctcgacaagctcacagccacccagaccgttgccctcgttgccattgacctcggccagaccaaccccatcagcgccggtatcagcagggttacccaagagaacggggcccttcaatgcgagcctctcgacagattcacccttcccgacgacctcctcaaagacatctccgcctataggatcgcctgggacagaaacgaggaggagctcagggccaggagcgtggaggccctccctgaggcccagcaggccgaggttagggccctcgatggagtctccaaagagaccgccaggacccagctttgcgccgacttcgggctcgacccaaagaggctcccttgggacaagatgtcaagcaacaccaccttcatcagcgaggccttgctctcaaacagtgtctccagggaccaagtgttttttaccccagcccccaagaagggcgctaagaagaaagctcccgtcgaggtcatgagaaaggacaggacctgggctagggcctacaagcccaggctcagcgtcgaggcccagaagctcaagaacgaggccctctgggccctcaagaggacctcccctgagtaccttaagctcagcagaaggaaggaggagctctgcaggaggagcattaactacgtgattgaaaagaccaggaggaggacccagtgccagatagtgattcccgtcatcgaggacctcaatgttaggttcttccacggcagcggaaagaggctcccagggtgggacaacttcttcaccgccaaaaaggagaacagatggtttatccaggggctccataaggctttcagcgacctcagaacccacaggtccttctacgtcttcgaagtgaggcccgaaaggacctccatcacctgcccaaagtgcgggcactgcgaggtcggcaatagagacggcgaagccttccagtgtctcagctgcgggaagacctgcaacgccgatctcgacgtcgccacacataacctcacccaggtcgccctcaccgggaagaccatgcccaagagggaggaacccagggacgcccagggcacagcccccgccagaaagaccaaaaaggccagcaagtccaaagctccacctgcagagagggaagaccagactcccgcccaggagccctcccagaccagt

SEQ ID NO: 139 - DNA, 2271 bp, Artificial
  synthetic
atgcccaaacccgccgttgagtctgagttctccaaggttctgaaaaagcacttccccggtgagaggttcaggagttcttacatgaaaagagggggcaagatacttgcagcccagggggaagaggccgttgtcgcctacctccagggcaaatctgaggaagagcctccaaacttccagccacccgccaagtgtcacgtggtcaccaagtccagagacttcgccgagtggcccatcatgaaggcctccgaagccatacaaaggtacatctacgctctctccactaccgagagggcagcctgcaagccaggaaagtcctctgagagtcacgcagcctggtttgcagccaccggagtgtccaaccacggctactcccacgtgcagggactgaacctgatctttgaccacacactgggtaggtacgatggtgtcctgaagaaagtccagttgaggaacgagaaggccagggccaggctggagtccatcaacgcctccagagctgatgaggggctgcccgaaatcaaggccgaagaggaagaggtggccaccaatgagaccggccaccttctgcagccacccggaatcaacccctccttttacgtttaccagaccatctctccccaggcctatagacccagagatgagatagtcctgccccctgagtacgcagggtacgtcagagaccccaacgcccccattcccctcggcgtcgtgaggaataggtgtgacatccagaaggggtgtccaggctacatccccgaatggcagagggaggccggaaccgctatctctcccaaaactgggaaagccgtgaccgtgccaggcctctcccccaagaaaaacaagaggatgagaaggtattggagaagtgaaaaggagaaggcccaagacgcccttctggttaccgttaggatcggaaccgactgggttgtgatcgacgtcagggggctcttgaggaacgccaggtggaggaccatcgcccccaaggacatatccctcaacgccctcctggacctgttcaccggtgatcccgtgatcgacgtgaggagaaacatcgtgacattcacatatacccttgacgcctgcggcacctacgcaagaaagtggactctgaaggggaaacagaccaaggccacattggataagctgaccgccacacagacagttgcccttgtggccatcgaccttggccagactaaccccatcagtgcaggaatcagtagggtgacccaggagaatggcgccctgcaatgtgagcccctcgatagattcaccctccccgatgaccttctgaaagacatctccgcctataggatcgcctgggacagaaacgaagaggaactgagggccaggtccgtggaggccctgccagaagcccaacaggccgaagtgagggccctggacggcgtgtccaaggagaccgccaggacccagctttgcgcagatttcgggctcgaccccaagaggctgccctgggacaaaatgtcctctaatacaaccttcatctcagaggccctcctgtccaactccgtttccagggaccaggtttttttcactcctgcccccaaaaagggggccaagaaaaaggcccccgtcgaggtgatgaggaaagacaggacctgggctagagcctataagcccaggctctcagtggaagcccaaaagctgaagaacgaggccctctgggccctgaagagaacctcccccgaatacctcaagttgtccagaaggaaggaagagctttgtagaaggtccattaattacgttatcgagaaaacaaggagaaggacccaatgccagattgtcatccccgtcatcgaggatcttaacgttagatttttccacgggtccggtaagaggttgcccgggtgggacaatttctttaccgccaaaaaggagaataggtggttcatccaaggattgcacaaggccttttccgacttgaggacccacaggtccttttacgttttcgaagtcaggcccgagaggacctccattacctgccccaaatgcggacattgcgaggtcgggaatagggacggggaagcattccagtgcttgagttgcgggaagacctgtaacgccgaccttgacgtcgccacccacaacctcactcaggtggccctgacaggcaagactatgcctaagagggaagagcccagggacgcccagggaaccgcccctgccaggaaaaccaaaaaggcctccaagtccaaggctccacccgccgagagggaagaccagactcctgcccaggaaccctcccagacctcc

SEQ ID NO: 140 - DNA, 2271 bp, Artificial
  synthetic
atgcccaagcccgccgtcgagagcgagttcagcaaggtcctcaagaagcacttccccggagagaggtttaggtccagctacatgaagagaggcgggaagatccttgccgcccagggcgaggaagccgtcgtcgcctacctccaggggaagagtgaggaggagccccctaacttccagccacccgccaagtgccatgtggtcaccaagtccagagacttcgccgaatggcccatcatgaaggcctcagaagcaatccagagatacatctacgccctctccactaccgagagggccgcctgtaagcccgggaagagtagcgagagccatgccgcctggttcgccgccaccggagtctccaaccatggatactcccacgttcagggcctcaacctcatctttgaccacaccctcggaaggtacgacggtgttctcaagaaggtccagctcaggaacgaaaaagccagggccaggttggaatccatcaacgctagcagggccgacgagggcctccccgagataaaagccgaggaggaagaggtcgccaccaacgagaccgggcacctcctccagccacccggtataaaccctagcttctacgtttatcagactatcagcccccaagcctataggcccagggacgagatcgtgctcccccccgagtacgccggatacgtcagggaccccaacgcccccatcccactcggggtggtcaggaacaggtgcgacatccagaaggggtgcccaggatacatccccgagtggcaaagggaagccgggacagccatcagccccaagaccggaaaagccgtcaccgttcctgggttgtcccccaagaagaacaagaggatgaggaggtactggaggtcagagaaggagaaggcccaagacgcactcctcgtcaccgttaggatcgggaccgactgggtggttatcgatgtgagaggccttttgagaaacgccaggtggagaactatcgcccccaaggatatttccctcaatgcactccttgacctcttcaccggggaccccgtcattgacgtcagaaggaacatcgtcaccttcacctacactttggacgcttgtggtacctacgctagaaagtggaccctcaagggcaagcagaccaaggccaccttggacaagctcactgccacccagaccgtcgccctcgtggccatcgatctcggacagaccaaccccatcagcgccggtatctcaagggtcacccaggaaaacggggctctccagtgcgagccacttgacaggttcaccctccccgacgatttgctcaaagacatcagcgcctacaggatcgcctgggacagaaacgaagaggagctcagggccaggtccgtcgaggctctccccgaggcccagcaggctgaggttagagccctcgatggggtgtccaaggaaaccgccagaacccagctctgcgccgacttcgggctcgaccccaagaggttgccctgggataagatgtcctccaacaccactttcatctctgaggccctcctcagcaacagtgtgagcagggaccaggttttctttacccccgcccccaagaagggggccaagaagaaggctccagttgaggtgatgaggaaggacaggacttgggccagggcatataagcccaggctcagcgttgaagcacaaaagctcaagaatgaggccctttgggccctcaagaggacctcccccgagtacctcaagctcagcagaaggaaggaggagctctgtaggaggtccatcaactacgtcatcgaaaagactaggaggaggacccaatgtcagatcgtcatccccgtgatcgaggacctcaacgtcagattcttccacggtagtggcaagagactccccgggtgggacaattttttcaccgccaaaaaagaaaataggtggttcatccagggcttgcataaggcattctccgacctcaggacccatagatccttctacgtgttcgaggttaggcctgagaggacttcaatcacatgccccaagtgcggacactgcgaggttgggaacagagacggggaagccttccagtgcctcagctgcggtaaaacctgcaacgccgatctcgacgtcgccacccataacctcacccaggtggctctcactggcaagactatgcccaagagggaggagcccagggacgcccaaggcactgcccccgccaggaagaccaagaaggcctctaagagcaaagccccccccgccgagagagaggaccagacccccgcccaggagcccagccaaacctcc

SEQ ID NO: 141 - DNA, 2271 bp, Artificial
  synthetic
atgcccaagccagctgtcgagagcgagttctcaaaggttcttaaaaagcactttcctggagagagattcaggtctagctacatgaagagaggcggcaagatactcgccgcccagggtgaagaagccgtggtcgcctacctccagggtaagtccgaggaggaaccccccaacttccagcccccagccaaatgtcacgtcgtcaccaaaagtagggactttgccgagtggcccatcatgaaggcctccgaagccatccagaggtacatctatgctctcagcaccaccgagagggcagcttgcaagcccggtaagagcagcgagtcccacgccgcctggttcgccgccaccggcgtcagcaaccacgggtactcccatgtccaaggactcaatcttatcttcgatcacaccctcggcaggtacgacggggtcctcaagaaggtccagctcagaaacgagaaagccagggctaggctcgagtccatcaacgcatcaagagccgatgaggggttgcccgagataaaggccgaggaggaggaggtcgccacaaacgagaccggccatctcttgcagccccccggaatcaacccctccttctacgtgtaccaaaccatctccccccaggcctacaggccaagggacgagatcgtgttgccccccgaatatgctgggtacgtgagggatcccaacgcccccatccccttgggggtggtgaggaacaggtgcgacatccaaaaaggctgccccggatacatccccgagtggcaaagggaggccgggaccgccatcagccccaagaccgggaaggcagtcaccgtgcccgggttgtctcccaaaaagaacaagaggatgaggagatattggaggtccgagaaagaaaaggcccaggatgcactcctcgtgaccgtcaggatcgggacagactgggtggttattgatgtgagagggctccttaggaacgccaggtggaggaccattgcccccaaagacatctctctcaacgcactcctcgacctttttaccggcgatccagttatcgacgtgaggagaaacatagtgaccttcacctacacactcgatgcatgcggtacctatgctagaaagtggaccctcaagggaaagcagaccaaagccaccctcgacaagctcaccgccacacaaaccgtggccctcgtggccatcgacctcgggcagaccaacccaatctctgccggaatctccagggtgacccaagagaacggagcactccagtgcgagcccctcgacagatttaccctcccagatgatcttctcaaagacatcagcgcctacaggatcgcttgggacaggaacgaggaggagctcagggccaggagcgttgaggccctccccgaggcacagcaggccgaggtgagggccctcgacggcgtcagcaaggagaccgccaggacccaattgtgcgccgacttcggcctcgacccaaagagactcccctgggacaagatgagctccaataccaccttcatctctgaggccctcttgtctaactccgtgagcagagaccaggtcttcttcaccccagcacccaagaagggagccaagaagaaggcacccgtcgaagtcatgaggaaggacaggacctgggccagggcatacaagcccagactcagcgttgaggcccaaaagcttaagaacgaagccctctgggccctcaagagaacctccccagaatacctcaagctcagcagaaggaaggaggagctctgcagaagatcaatcaactatgttatcgagaagaccagaaggaggacccaatgccaaatcgtcattcctgtgattgaggacctcaacgtgaggtttttccatggctccggcaagagactcccggggtgggataacttctttaccgccaagaaggaaaacaggtggttcatacagggtctccataaagccttctctgatttgaggacccacagaagcttttacgtgttcgaggtgagacccgagaggaccagcatcacctgccccaagtgcgggcactgcgaggtcgggaacagggatggcgaggccttccagtgcctcagttgcggcaagacctgcaacgccgacctcgatgttgctacccacaatctcacccaggtcgcccttaccgggaagaccatgcccaagagggaggaacccagggacgcccaaggtaccgcccccgccaggaagaccaaaaaggcctccaagagcaaagccccccctgccgaaagagaggaccaaacccccgcccaggagcccagccagaccagt

SEQ ID NO: 142 - DNA, 2271 bp, Artificial
  synthetic
atgcccaaacccgccgtcgaaagcgagttctcaaaggtcctcaaaaagcacttccccggagagaggtttaggagcagctacatgaaaaggggcggcaaaatcctcgccgcccagggagaggaggctgtcgtggcatacctccaggggaagagtgaggaggagccccctaacttccagccccccgcaaaatgtcacgtcgtgaccaaatccagggacttcgccgaatggcctatcatgaaggccagcgaagccatccagaggtatatctacgccctttcaaccaccgagagggcagcttgcaaaccaggtaagtcctccgagtcccacgccgcctggttcgccgccaccggtgtctccaaccatgggtactcacacgtgcaggggctcaaccttatcttcgaccataccctcgggaggtacgacggcgtcttgaagaaagtccagctcaggaacgagaaggccagagccaggctcgagtccataaacgcatccagagctgacgaggggctccccgagatcaaggccgaagaggaggaggttgccaccaacgagactgggcacctcctccagccacccgggataaacccctctttctacgtgtaccaaactatctccccccaggcctataggcccagagacgagatcgtgctcccacccgaatacgccgggtacgtgagggatcccaatgcccccatccccctcggagttgtgagaaacagatgcgacatccagaaggggtgccccgggtacattcccgaatggcaaagggaagccggcaccgccatatcccccaagaccggcaaggctgtcaccgtgcctgggctctcccccaagaaaaacaagagaatgagaaggtattggagatccgagaaggaaaaagcacaggacgccctccttgtgaccgtcaggatcggcaccgactgggttgttatcgatgtcaggggcctcctcagaaacgccaggtggaggaccattgcccccaaggacatcagcctcaacgccctcctcgatctctttaccggggaccccgttatcgacgtcaggaggaacattgtgacattcacctataccctcgacgcctgtgggacttacgccagaaaatggaccctcaaggggaagcaaaccaaggccaccctcgacaagttgaccgcaacacaaacagtcgccctcgtggccatcgacctcggtcagacaaaccccatctccgccggcatctccagggtgacccaggagaacggggccctccagtgcgagcctctcgataggtttaccctcccagacgacctcctcaaggacatcagcgcctacaggatcgcctgggataggaatgaggaagagctcagggccaggtccgtggaggccctccccgaggcccaacaggcagaggtgagggccctcgacggggtgtccaaggagaccgccaggactcagctctgtgccgacttcggcttggatccaaagaggctcccctgggacaagatgagcagcaacaccacctttatctccgaggccctcctctccaactccgtctcaagggaccaggtgtttttcacccccgcccccaagaagggtgctaagaaaaaggcccccgtggaggttatgaggaaagacagaacttgggccagggcctacaagcccaggttgtccgttgaggcccaaaagctcaagaacgaggccttgtgggccctcaagagaacttcacccgaataccttaagcttagtaggaggaaggaggagttgtgtaggaggtccatcaactacgtgattgagaaaaccaggaggaggactcagtgtcagatcgtgatccccgtgatcgaggacttgaacgttagattctttcacgggagcggtaagaggttgcccgggtgggacaatttcttcaccgcaaagaaagagaataggtggttcatccaaggcctccacaaggctttcagcgaccttagaacacatagaagcttctacgtctttgaagttaggcctgagaggaccagtatcacctgccccaagtgcggccactgcgaggtggggaacagagacggggaagcattccaatgcctttcctgcggcaagacctgcaacgccgacctcgacgtcgctactcacaacctcacccaggtggccctcaccggcaagactatgcccaaaagggaggagcccagggatgctcagggtaccgcccccgccaggaagaccaagaaggcatccaagagcaaggctcccccagccgagagggaagaccagacccctgcccaggagccctcccagacctcc

SEQ ID NO: 143 - DNA, 2271 bp, Artificial
  synthetic
atgccaaaacccgccgtcgaatccgagttcagcaaggtcctcaagaagcatttccccggggagaggttcaggtcctcctatatgaagaggggaggcaagatcctcgctgctcagggcgaggaagccgttgtggcctacttgcaggggaagagcgaggaagagccccccaacttccagccccctgccaagtgccacgttgtgacaaagtccagggacttcgccgagtggcccatcatgaaagccagcgaggccatccagaggtatatctacgccctcagcactactgagagagctgcctgcaagcccgggaagtctagcgaatcccacgccgcctggtttgccgccaccggcgtgagtaaccacggttacagccatgtgcagggcctcaaccttatctttgatcacaccctcgggaggtacgatggcgttcttaagaaggtgcagctcagaaatgagaaggcaagggccaggcttgagagcattaacgcctccagggccgacgaggggcttcccgagatcaaggctgaggaggaggaggttgcaaccaacgagaccggccacctcctccaaccacccgggatcaatccctccttctacgtttaccagacaatatcccctcaggcctacagacccagggacgaaattgtcctccccccagaatacgcagggtacgtgagggaccctaacgcccccatcccccttggcgtcgttaggaacaggtgtgacatccaaaaggggtgccccggctacatccccgagtggcaaagagaggccggtaccgccatctctccaaagaccggcaaggccgtcaccgtccccggcctctcccccaaaaagaacaagaggatgaggagatactggaggtcagaaaaggagaaggcccaagacgccctcctcgtgactgtgagaatcggcaccgactgggtcgttattgatgtgagggggcttctcaggaacgccaggtggaggaccatcgccccaaaagacatcagcctcaatgctctcctcgacttgttcaccggcgaccccgtcatcgatgtcaggaggaatattgtgaccttcacatacaccctcgacgcctgcgggacctacgcacgtaagtggactctcaagggcaagcagaccaaggccactctcgacaaactcaccgccacccagactgtggccctcgtggccatcgaccttgggcagaccaatcccataagcgccgggatcagcagagtcacccaggagaatggggccctccaatgcgagcccctcgacaggttcaccctccccgacgatctccttaaggacatttctgcctacaggatcgcctgggacaggaacgaagaagaactcagggccagatccgtcgaggcactccccgaggcccagcaggccgaggtcagggccttggacggcgtgtcaaaagaaaccgccaggactcagctctgcgccgactttgggctcgaccccaaaaggttgccctgggacaagatgtccagcaacaccaccttcatctccgaggctttgctctccaattctgtgagcagggaccaggtgttctttacacccgcccccaagaagggtgccaagaagaaggcccctgtcgaggtcatgaggaaggacaggacctgggccagagcctacaagcccaggttgtccgtggaggctcagaagttgaaaaacgaggccctctgggcactcaagaggacaagcccagagtacctcaagctctccaggaggaaggaagagctctgcaggaggtccatcaactacgttatcgagaaaacaaggaggaggacccagtgccagatcgtgattcccgtcatcgaggacctcaacgtcaggttcttccacgggagcggcaagaggcttcccgggtgggacaacttcttcaccgctaagaaggagaacaggtggttcatccagggccttcacaaggccttctccgatctcaggacccacaggtccttctatgtgttcgaggtcaggcccgaaaggacctccataacctgccccaagtgcgggcactgcgaggtgggtaacagggacggtgaggcctttcagtgcttgagttgcggcaaaacctgcaacgccgacctcgacgtcgctacccataacctcacccaagttgccctcaccggaaagaccatgcccaaaagagaggagccaagggacgcccagggcaccgcccccgccagaaagaccaagaaggcctctaagagcaaggccccccccgccgagagggaggaccagacccccgcccaggaacccagccagacatca

SEQ ID NO: 144 - protein, 766 aa, Unknown
  bacteriophage
MEKEITELTKIRREFPNKKFSSTDMKKAGKLLKAEGPDAVRDFLNSCQEIIGDFKPPVKTNIVSISRPFEEWPVSMVGRAIQEYYFSLTKEELESVHPGTSSEDHKSFFNITGLSNYNYTSVQGLNLIFKNAKAIYDGTLVKANNKNKKLEKKFNEINHKRSLEGLPIITPDFEEPFDENGHLNNPPGINRNIYGYQGCAAKVFVPSKHKMVSLPKEYEGYNRDPNLSLAGFRNRLEIPEGEPGHVPWFQRMDIPEGQIGHVNKIQRFNFVHGKNSGKVKFSDKTGRVKRYHHSKYKDATKPYKFLEESKKVSALDSILAIITIGDDWVVFDIRGLYRNVFYRELAQKGLTAVQLLDLFTGDPVIDPKKGVVTFSYKEGVVPVFSQKIVPRFKSRDTLEKLTSQGPVALLSVDLGQNEPVAARVCSLKNINDKITLDNSCRISFLDDYKKQIKDYRDSLDELEIKIRLEAINSLETNQQVEIRDLDVFSADRAKANTVDMFDIDPNLISWDSMSDARVSTQISDLYLKNGGDESRVYFEINNKRIKRSDYNISQLVRPKLSDSTRKNLNDSIWKLKRTSEEYLKLSKRKLELSRAVVNYTIRQSKLLSGINDIVIILEDLDVKKKFNGRGIRDIGWDNFFSSRKENRWFIPAFHKAFSELSSNRGLCVIEVNPAWTSATCPDCGFCSKENRDGINFTCRKCGVSYHADIDVATLNIARVAVLGKPMSGPADRERLGDTKKPRVARSRKTMKRKDISNSTVEAMVTA

SEQ ID NO: 145 - DNA, 2298 bp, Artificial
  synthetic
atggaaaaggagatcactgagttaaccaagattagacgagaattccctaataagaaattcagctcaaccgatatgaagaaggccggaaaattgttaaaggcagagggtccagatgctgtcagagattttttaaattcgtgtcaggagattattggagacttcaagcctcccgtgaagactaacatcgtttccatctcgcggcccttcgaggagtggccagtgtcgatggtagggagggctattcaagagtattacttctctttgactaaggaagaacttgaatcagtgcatccgggcacgtcatctgaggatcataaatcattctttaatataactggactctccaattataactacacctccgttcagggacttaatctcatctttaaaaatgcaaaagctatttatgatggaactttggttaaggccaacaacaagaataagaaattagaaaagaaatttaatgagatcaatcataagcgctcactcgaaggactaccaataatcacacctgacttcgaggagcccttcgacgaaaacgggcacctcaataatcctccaggaattaacagaaatatttatggatatcagggctgcgccgctaaagtttttgtgccatcaaaacacaagatggtatcgctgccaaaggagtacgaaggttataacagagacccaaatctgagtctcgcaggtttcaggaatcgtcttgaaatcccggagggagaaccaggtcatgtcccatggttccaacgaatggacatacctgaggggcaaattggacacgtaaacaagattcagcgatttaattttgttcacggcaagaattcaggtaaggtgaaattcagcgacaagacagggcgcgtgaagagatatcaccatagcaagtataaggacgcaactaaaccttataaattcttggaggaatctaagaaggtgtcggctctcgatagcatattagcgatcattacaatcggcgatgattgggttgtgtttgatatacgaggactctatagaaacgtcttttatagagagcttgctcaaaaaggtttgactgccgtccaattgctggatcttttcaccggtgatcccgttattgacccaaagaagggagtcgtaactttctcctataaagagggggttgtgcctgtcttttcccagaaaatcgttcctcgttttaaatcacgagacaccttagagaagctcacgtcacaggggcctgttgcgcttttgagcgttgatcttggacagaatgagcccgtcgcagccagggtgtgttctcttaagaatattaacgacaagattaccctagataacagttgccgtatatcttttcttgatgattacaaaaagcaaataaaagactaccgtgattccctcgatgaattggaaattaaaatccgccttgaagcgattaatagtttggagactaaccagcaggttgagattagggatctggacgtattttctgctgatcgggccaaagcaaacacagtggatatgttcgatatcgacccaaatctaatctcctgggacagcatgagtgatgccagagtttcaacccaaataagtgacctgtatcttaagaatggaggggatgaatcaagggtgtacttcgagattaataataaaaggattaagagatcagactataacattagccagttggtgcgcccaaagctttcagatagtacaaggaagaacctaaatgattctatctggaaactcaagcgtacttctgaggaatatcttaaactatcaaagcgtaaacttgagctcagcagagctgtggttaactacaccattagacaaagtaagttactttctggtatcaatgatatcgttatcatcctggaagatttggacgttaagaagaagtttaacggacgtggtattcgcgacatcgggtgggacaatttcttctctagccgaaaggaaaaccgctggtttatccctgctttccataaggctttttccgaactttcatccaacagagggctttgtgtgatagaagtaaaccctgcatggaccagtgcaacctgcccagactgcggcttctgcagtaaagaaaacagagacggtattaattttacatgcagaaagtgcggtgtcagttatcatgctgacattgacgtggcaaccctaaatattgcaagggtagcagtcttgggaaagcctatgtcaggtcccgctgatcgcgagcgtctgggagatactaagaaaccaagagttgctcggtctaggaaaacaatgaagcggaaggatataagcaattcaactgtggaggccatggtcacagcg

SEQ ID NO: 146 - DNA, 2298 bp, Artificial
  synthetic
atggagaaggaaataaccgaactcacaaaaatcaggagggaattccccaacaaaaagttctcctccaccgacatgaagaaggccggcaagttgctcaaggccgagggccctgacgccgtgagggatttcctcaattcctgccaagagatcatcggagactttaaaccccccgtcaagactaacatcgtcagcataagcaggccattcgaggagtggccagtctccatggtgggcagagccatccaggagtactacttcagcctcaccaaggaggagctcgagtccgtgcaccccgggactagcagtgaagaccataagagcttcttcaacattaccgggctctccaactacaattacacctccgttcagggtttgaacctcatcttcaagaacgccaaagccatctatgacggcactctcgttaaagccaacaacaagaacaagaagctcgaaaagaagttcaatgagattaaccacaagaggtccctcgagggcctccccatcatcacccccgacttcgaggagcccttcgatgaaaatgggcacttgaacaacccccccggtattaacaggaacatctatgggtatcagggctgcgccgccaaagtcttcgtgccatccaagcataagatggttagcctcccaaaggagtacgaggggtataacagggaccccaacttgtccctcgccgggttcaggaacagactcgagatcccagagggagagcctggccacgtgccttggttccagaggatggatatacccgagggacagattggccacgtgaacaagatccagaggttcaatttcgtccacgggaagaattccggaaaagtgaaattcagcgataaaaccgggagggtcaagaggtaccaccacagtaagtacaaggatgcaaccaagccctacaagtttctcgaggagagtaagaaagtctccgctctcgacagcatcctcgccatcattacaattggggacgactgggtggtcttcgacatcagagggctctacaggaacgtcttttacagggagctcgcccagaaggggctcaccgccgtgcagctcctcgacctcttcaccggggaccccgtgatcgaccccaaaaaaggagtcgttaccttctcctataaggagggagtggtccccgtttttagccagaagatcgttcccaggtttaagtccagggacaccctcgagaagcttaccagccagggccccgtcgcccttttgtctgtcgaccttggacaaaacgagcccgtggccgcaagagtctgttccctcaagaacatcaacgataagatcacccttgataattcatgtagaatcagcttcctcgatgactacaaaaagcagatcaaggactatagagactccctcgacgagctcgagatcaagattaggctcgaagccatcaacagccttgagaccaaccaacaagtcgaaatcagagatttggacgttttctcagcagatagagccaaggccaacaccgtcgacatgttcgacatcgacccaaacctcatctcctgggactccatgtctgacgccagggtctccacacagatctccgatctttacttgaaaaatggcggtgacgaatccagagtttactttgagatcaataacaagaggatcaaaaggagcgactacaacatatcccagctcgtcaggccaaagctctccgacagcaccaggaagaacctcaacgattccatctggaaactcaagagaaccagcgaggagtacctcaagctctcaaagagaaagctcgaactcagcagggccgtcgtcaactacaccatcaggcagtccaagctcttgtccgggataaacgacatcgtcatcatattggaggatctcgacgttaaaaagaagttcaacggcagaggcatcagggacatcggttgggacaatttcttctctagtaggaaggaaaacaggtggttcatccccgccttccacaaagcctttagcgagctcagctccaataggggcctttgcgttatcgaagtcaaccccgcctggacatctgccacttgcccagactgtggcttctgtagcaaggaaaacagagacgggatcaactttacctgtaggaagtgcggggtctcctaccatgccgacatcgacgttgccactcttaacatcgccagggtcgccgtcctcggcaagcccatgtccggccccgccgatagggagaggttgggcgacaccaagaaacccagggtggccagaagcaggaagaccatgaagaggaaagacatcagcaactctaccgtggaggccatggttaccgcc

SEQ ID NO: 147 - DNA, 2298 bp, Artificial
  synthetic
atggagaaggagatcaccgagctcacaaaaatcaggagggagttccccaacaagaagttctcaagcactgacatgaagaaggccggcaagctcctcaaggccgagggccccgacgccgtcagggacttcctcaactcctgtcaggaaatcataggagacttcaagccccccgtgaaaaccaacatcgtttccatcagcaggcccttcgaagagtggcccgtcagtatggtcgggagagccatccaagaatactatttcagcctcaccaaggaagaactcgagtccgtccatcccggaacctcctctgaggaccacaaaagcttctttaatatcaccggcctcagcaattacaactacaccagcgtgcagggcttgaatctcatcttcaaaaacgccaaagccatctacgacggtactctcgttaaggccaacaacaaaaacaagaagttggagaagaagttcaacgaaatcaaccacaagaggtccctcgagggcctccctataatcacccccgacttcgaggaacctttcgacgagaacgggcacctcaacaacccccccggcattaataggaacatctacggctaccagggctgcgctgccaaagttttcgtgcccagcaagcacaagatggtgagcctccccaaggaatacgaaggttacaacagggaccctaacttgtcccttgccggcttcaggaacaggctcgagatccccgagggggaacccggacacgtgccctggtttcagaggatggacatcccagagggccagatcggccacgtcaataaaatacagaggttcaattttgtccacggcaagaacagcgggaaggtcaagttttccgacaagaccggcagggttaaaaggtaccaccacagcaagtacaaggacgctaccaagccctacaagtttctcgaggagagcaaaaaggtgagtgccctcgactcaatcctcgccatcatcaccatcggcgacgattgggtggtttttgacatcaggggtctctataggaacgtgttctatagggagctcgcccagaaggggctcaccgctgtgcagctcttggacctcttcactggggaccccgtcattgaccccaagaaaggggttgtgacattctcctacaaagaaggcgtggtgcccgtgttcagccagaagattgtccccagattcaaatccagggataccttggagaagctcaccagccagggccctgtggcccttttgtccgtggacctcggccagaacgaacccgtcgccgccagggtctgttcactcaagaacatcaacgataagatcaccctcgacaactcctgcaggatcagtttccttgacgattataagaagcagatcaaggattacagggactccctcgatgaattggagatcaagatcaggttggaggccatcaacagcctcgagaccaatcagcaagttgaaatcagggacctcgacgtgttctcagctgacagggctaaggctaacactgtcgacatgttcgacatcgaccccaacctcatatcctgggattccatgagcgacgcaagagtgtccacccagatctccgacctctacctcaagaacggcggagacgagtccagggtctatttcgagatcaacaacaagaggatcaagaggtccgactacaacatcagccaacttgtcaggcccaaattgtctgactctaccaggaagaacctcaacgactccatctggaaactcaagaggacctccgaagagtacctcaaactcagcaagaggaagctcgagctctccagggccgttgtgaattacaccatcaggcagtccaagctcctttccggtatcaacgacatcgtgatcatcctcgaagacctcgacgtgaagaagaagtttaatggcagaggtattagggacatcgggtgggacaatttcttcagctccagaaaggaaaacaggtggttcatccccgcctttcacaaggcctttagcgaactcagctccaacagagggctctgcgtcatagaggtgaacccagcctggacctcagccacttgccccgattgtggcttttgctctaaagagaacagggacggcatcaacttcacctgcaggaaatgtggcgtgtcctatcacgccgacatcgacgttgccaccctcaatatcgccagagtggctgtcctcggaaagcccatgtccgggcccgctgatagggagagacttggggacaccaagaagccaagggtcgccaggtccaggaaaaccatgaaaaggaaggacatctccaattccactgtggaggccatggtgaccgct

SEQ ID NO: 148 - DNA, 2298 bp, Artificial
  synthetic
atggagaaggaaatcaccgagctcactaaaattaggagggagttccccaacaaaaagttttcttccaccgatatgaagaaggccggtaagctcctcaaggccgagggcccagacgccgtgagggacttccttaactcctgccaggagatcattggcgacttcaagccccccgttaaaaccaacatagtgtctatctccaggcccttcgaagagtggcccgtgagcatggttggaagggccattcaggagtactatttctcactcaccaaggaggagctcgagagcgttcaccctgggacctcctccgaagaccataaaagctttttcaacatcaccggattgtccaactacaactatacctccgtccagggtctcaatcttatctttaagaatgccaaagccatttatgacgggaccctcgtgaaggccaacaacaaaaataagaagcttgagaagaagtttaacgagattaaccacaaaaggtctctcgagggcctccccatcatcacccccgacttcgaggagccattcgacgagaatgggcacctcaacaacccacccgggatcaataggaacatctacggctaccaggggtgcgccgccaaggtgtttgtccccagcaagcacaagatggtttccctccccaaagagtacgaggggtataacagggatcctaatctctccttggctggattcaggaacaggctcgagatcccagaaggagagcccggtcacgttccttggtttcagaggatggacatccccgagggccagatcggccacgtcaataagatccagaggttcaactttgtgcacggtaagaactccggtaaggttaaattttcagataagaccggcagagtgaagaggtatcaccattccaagtacaaagacgccaccaagccttataagttcctcgaagaaagcaaaaaagtgagcgccctcgacagcatcctcgctatcatcaccataggggacgactgggtcgttttcgatatcagggggctttacagaaatgttttctacagagaactcgcccagaaaggcctcaccgccgtccagttgctcgacctcttcaccggggaccccgttatcgaccccaagaagggcgtggtcaccttctcatacaaggaaggagtggttcccgttttctcccaaaagatcgtgcccagattcaagagcagggacacccttgagaagctcaccagccagggccccgtggcccttctttcagtcgacctcgggcaaaacgagcccgtcgctgctagggtgtgctccctcaagaacatcaacgataagatcaccctcgacaattcctgcaggatctcctttctcgatgactacaagaagcagataaaggactacagggactccctcgacgagctcgaaattaagatcaggttggaggctattaatagcctcgagaccaaccagcaagttgaaatcagagacctcgacgttttctccgccgacagggccaaggccaacaccgtcgatatgttcgatatcgaccccaacctcatcagctgggacagcatgtctgacgcaagggtcagcacacagatcagtgatctctacttgaagaacggtggcgatgaaagcagggtctactttgaaatcaacaataaaaggatcaagaggagcgattataacatcagccagctcgtcaggcccaaactcagcgacagcaccagaaaaaatctcaacgacagcatctggaagctcaagaggactagtgaggaatacctcaaactcagtaagaggaaactcgaactcagcagggccgtggtgaactacaccattagacagtcaaagctcttgtctggcatcaacgacattgtcatcattttggaggacctcgacgtgaaaaagaagttcaacggaagggggataagggacatcggttgggacaatttctttagctccaggaaggagaacaggtggttcatcccagccttccataaagctttctcagagttgtcctcaaacagaggtctctgcgtgatcgaggttaaccccgcatggacctccgctacatgccccgactgcggcttttgctccaaggaaaacagggacggcatcaacttcacatgcagaaagtgcggcgtgtcctaccatgccgacatcgacgtcgctaccctcaatatcgccagggtcgccgtccttgggaagcccatgagcggcccagctgacagggagaggcttggggatacaaagaagcccagggtcgccaggagccggaagaccatgaagaggaaggacatttctaactctaccgtggaagccatggtcaccgcc

SEQ ID NO: 149 - DNA, 2298 bp, Artificial
  synthetic
atggagaaagagatcactgagcttactaaaattagaagggagtttcctaataagaaatttagttctaccgatatgaagaaggcagggaaactgctcaaggcagagggccccgacgccgtgagggacttccttaactcctgccaagaaattatcggggactttaagccacccgtcaaaaccaacattgtttccatctctaggcctttcgaagagtggcctgtttccatggtggggagggccatccaggagtattacttctccctcaccaaggaagagctggagtccgtccaccccgggacctcatccgaggaccataaatccttctttaacattaccgggctctccaactacaattacacctccgtccaaggcctcaacctgatatttaagaacgccaaggccatttacgacgggaccctcgtgaaagccaataacaaaaataagaagcttgaaaaaaaatttaacgagattaaccacaaaagatccctggaggggcttcccataatcactccagacttcgaagagccctttgatgagaacggccacctgaataacccacccgggattaataggaacatctacgggtaccagggatgcgctgccaaggtttttgtcccttccaaacataaaatggtctccctccctaaagagtacgagggctacaacagagaccccaacctgagtctggccggcttcaggaacaggctggagatccccgagggtgaacccggtcacgtgccctggtttcaaaggatggacatccccgagggacagatagggcacgtgaataaaatacaaaggttcaacttcgtgcacggaaaaaactccggcaaggttaagttctccgataaaaccggcagggtcaagaggtaccaccattccaaatataaggacgccaccaaaccctacaagttcctggaagagtccaagaaagtgtctgctctcgattccattctcgctataatcaccattggcgatgactgggtggtcttcgacatcagaggattgtataggaacgtcttttatagggagcttgcacaaaaaggactgaccgccgtccaactcctggaccttttcaccggggatccagtgatcgatccaaaaaagggagtggtcaccttctcctacaaagagggggtcgtgcccgtgttctcccagaagatcgttcccaggtttaagtccagggataccttggaaaagctgacctcccaaggtcccgtcgccctgctctccgtggatctggggcagaacgagcccgttgctgccagggtctgctccctcaagaacatcaacgacaagatcactcttgacaactcctgtaggatctccttcctggacgattataaaaagcagattaaagactacagagactccctggacgagctggaaatcaaaataaggctcgaagccatcaactcccttgagacaaaccagcaagtggagatcagggatctcgatgtgttctccgccgacagggccaaggccaacaccgtcgacatgttcgacatcgatcccaacctgatctcatgggactccatgtccgacgcaagggtgtcaacccaaatctccgacctctatttgaagaacggtggcgatgagagtagagtgtattttgagatcaataataagaggattaaaaggtccgactataacatctcacagctcgttaggcccaagctgtccgactccactaggaagaacctgaacgactccatctggaagctcaagaggacctccgaagagtatctcaagctctccaaaaggaagctcgaactgtcaagggccgtggtcaattacacaatcagacaatccaagctgctctccgggatcaacgacatcgtgataatcctggaggacctcgacgttaagaaaaagttcaacggcaggggcatcagagatatcggctgggataatttctttagttccaggaaagagaatagatggttcatccccgccttccacaaggccttttccgaactctcatccaatagggggctgtgcgttatcgaggtcaatcccgcctggacctccgcaacctgcccagactgcggcttttgttccaaagaaaacagggatggaattaacttcacttgcagaaagtgcggcgtgtcctaccacgccgacatcgacgtcgccacactcaacatcgcaagggtggcagttctggggaagcccatgtccggtcccgccgatagggaaaggctcggcgatactaagaaacccagggtggcaaggtccagaaagaccatgaagaggaaggatatttccaattcaaccgtcgaggccatggtcaccgcc

SEQ ID NO: 150 - DNA, 2298 bp, Artificial
  synthetic
atggagaaagagatcaccgagcttaccaagatcaggagggagtttcccaacaagaagttcagcagtaccgatatgaagaaggccgggaagctcctcaaggccgaaggcccagacgccgtgagagacttcctcaattcatgccaggagatcatcggggacttcaagccccccgtcaagaccaacatcgtgtctatcagcaggcccttcgaagagtggccagtgtccatggtcgggagggccatccaggaatactacttcagtttgaccaaagaggagctcgaaagcgttcaccccgggacctcctccgaggaccacaaaagttttttcaacatcaccgggctctccaactacaactacacaagcgtgcagggcctcaacctcatcttcaaaaacgccaaggccatctacgacggcaccctcgtcaaagccaacaacaagaacaaaaagctcgagaagaaattcaacgaaattaatcacaagaggagcttggagggcctcccaataataacccccgacttcgaggagcctttcgacgaaaacgggcatctcaataacccccccgggatcaataggaatatctacgggtatcaggggtgtgccgccaaggtgttcgttcccagcaaacataagatggtgtccctccctaaggagtacgaggggtacaacagggatcccaacctcagccttgccggcttcaggaacagactcgagatcccagaaggggagccagggcacgtgccatggtttcagaggatggacattcccgagggccaaatcggacacgttaacaaaatccagagattcaactttgtccacggaaagaactccggcaaggttaagttttccgacaagaccgggagagtgaagaggtaccaccactccaagtataaggacgccactaagccctacaagtttcttgaggaaagtaagaaggtgtccgccttggactccattctcgctatcatcaccatcggggatgactgggtggtttttgacattaggggcttgtacaggaacgtcttctacagggagctcgcccagaagggactcaccgccgtccagctccttgacctctttaccggggaccccgtgattgacccaaaaaaaggcgtcgtcaccttctcctacaaggagggcgtggtgcctgttttctcccaaaagatcgtgcccaggttcaagagtagggatacccttgaaaagctcaccagccagggacctgttgccctcctcagcgtggacctcggccaaaacgagccagtcgccgccagggtctgctccctcaaaaacatcaacgacaaaatcaccctcgacaactcatgcaggatctccttcctcgacgactacaagaagcaaatcaaggattacagggactccctcgacgagctcgagatcaaaatcaggctcgaggctataaactccttggaaactaaccaacaggtcgagataagggacttggacgtgttcagcgccgatagggctaaggccaatacagtggacatgttcgacattgatcccaacctcatttcctgggactccatgtccgatgctagggtgtccacccagatctccgacttgtacctcaagaacggcggggacgagagcagggtctattttgagatcaacaataagaggatcaagaggagcgactacaacatatcccagctcgtcaggcccaagctcagcgattccaccagaaagaatctcaatgacagcatctggaagctcaagaggaccagcgaagagtaccttaagctctccaagagaaaactcgagctcagtagggccgtggtcaactataccatcagacaatccaagctcctttcaggcatcaacgacatcgtgatcatccttgaagacctcgacgtgaaaaaaaagttcaacgggaggggtatcagggatatcgggtgggacaatttcttttcctccaggaaagaaaacaggtggttcatccccgccttccacaaggccttctccgagctctcctccaacaggggtctctgcgtgatcgaggtgaatcccgcctggaccagcgccacttgccccgactgtgggttctgctccaaagagaatagagacggcatcaacttcacctgcagaaaatgcggggtctcatatcacgccgatatcgacgtggccactcttaatatcgccagggtggccgtgctcggtaaacccatgtcagggcccgccgacagggagaggttgggggacaccaagaaacccagggtggccaggagcaggaagaccatgaagagaaaagacatcagcaacagcaccgtggaggccatggtgacagcc

SEQ ID NO: 151 - DNA, 2298 bp, Artificial
  synthetic
atggagaaggagataaccgaactcaccaagatcaggagggagttcccaaataagaaattcagctcaaccgacatgaagaaagctggcaagctcctcaaggccgaaggacctgatgctgttagagacttcctcaactcctgccaggagatcataggcgattttaagccccccgtcaagactaacatcgtgtctataagcaggccttttgaggaatggcccgtgagcatggtcggcagagccatacaggagtattatttcagcctcacaaaggaggagttggagtccgttcacccaggtaccagctccgaggaccataaatccttcttcaacatcaccggcctttccaactacaattataccagcgtgcaggggcttaatctcatctttaaaaacgccaaggccatctacgacgggacactcgtcaaagctaacaacaagaataagaagttggagaagaagtttaacgagatcaaccacaagaggtccttggaggggctccctatcatcactcccgacttcgaggagcccttcgacgagaacgggcacctcaacaacccccctgggatcaacagaaacatctacggataccaggggtgcgccgccaaagtctttgtccccagcaaacacaaaatggtcagcctccccaaggagtacgagggctacaacagagatcccaacctctccctcgccgggtttaggaacagactcgagatccccgagggggagcccgggcatgtcccctggtttcagagaatggatattcccgaggggcaaatcggtcacgtcaataaaatccaaaggtttaactttgtccacgggaaaaactctggcaaggtgaagttcagcgataagactgggagggtgaagaggtaccaccacagcaagtataaggacgccacaaagccctacaagttcctcgaggagagcaaaaaggtctctgctctcgatagcatcctcgccatcatcaccatcggcgatgactgggtcgtgttcgacatcagaggcctctacaggaacgtgttctacagggagctcgcccagaaggggctcacagccgttcagctcctcgacctttttaccggggaccccgtcatcgaccccaagaagggcgttgtcactttctcctacaaagagggcgtggtccccgtcttctcccaaaagattgttcccaggtttaaaagtagggacacattggaaaagctcacctcccagggccccgtcgccctcctctccgttgatctcgggcagaacgagcccgtggcagccagggtttgctccctcaaaaacataaatgacaaaatcaccctcgataactcctgcaggatcagcttcttggacgactacaaaaagcagataaaggactatagagacagcctcgacgagctcgaaataaaaatcaggttggaagccatcaactctctcgagactaaccagcaggtggagatcagggaccttgacgtgtttagcgccgacagggccaaggccaacactgtggacatgttcgacattgacccaaacctcatcagctgggacagcatgagcgacgccagggtttccacccagatctccgacctctacctcaagaacggcggggatgagagcagggtgtacttcgagatcaacaacaagagaataaagaggagcgactacaatatatcccagctcgtcaggcccaaactcagcgacagcaccaggaagaatttgaacgactcaatatggaagctcaagaggacctcagaagagtacttgaaattgtccaagaggaaactcgagctcagtagggccgttgtgaactacaccattaggcagagcaagctcctcagcgggatcaatgacatagttatcatactcgaggacctcgatgtcaagaagaagttcaacggcagaggcattagggatatcggctgggataatttcttctcctccaggaaagagaatagatggttcatcccagccttccacaaagccttcagcgagctctccagcaacagaggattgtgcgtgattgaggtcaaccctgcttggacctctgccacatgcccagactgcggattctgcagcaaggagaacagagacgggataaattttacatgcaggaaatgtggagtctcctaccacgcagacatcgacgttgccacactcaatatcgcaagagttgccgtgcttgggaagcccatgagcggccccgccgatagggaaaggctgggggacacaaagaaaccaagggtcgcaaggagcaggaagaccatgaaaaggaaggatatcagcaactctacagtcgaggccatggttaccgcc

SEQ ID NO: 152 - DNA, 2298 bp, Artificial
  synthetic
atggaaaaagaaattactgagctcacaaaaatcagaagggaattccccaacaaaaagtttagcagcaccgacatgaaaaaggccggtaagctcctcaaggccgaggggcccgacgccgtgagggactttctcaacagttgccaggagatcattggagatttcaagccccccgttaagaccaacatcgtttccatatctagacccttcgaggagtggcccgtctctatggttgggagggccattcaagagtattacttctccctcaccaaagaagagcttgaatctgttcatcccgggaccagttccgaggaccacaagagcttcttcaacatcaccgggttgagcaattacaactacacctccgtgcagggacttaacctcatcttcaagaatgctaaggctatctacgatggaaccctcgtcaaagccaataataagaacaagaagcttgagaaaaaattcaacgagattaaccacaagaggagcctcgaggggctcccaattatcacccccgatttcgaggagcccttcgacgagaacgggcacctcaataacccccccggaatcaatagaaatatatacggataccagggatgtgccgcaaaggttttcgtccccagcaaacacaagatggtgtccctccccaaggagtacgaggggtacaaccgagaccccaacctctcccttgccggttttagaaataggctcgagatccccgagggggagcccggtcacgttccatggttccagagaatggacatccctgaagggcagatcggtcacgtcaataaaatccagaggttcaatttcgttcacgggaagaactcaggcaaggtgaagtttagcgacaaaaccggaagagtgaaaaggtaccaccactccaagtacaaggacgccacaaagccatacaagttcctcgaagagagcaaaaaggtgagcgccctcgatagcatacttgccatcatcaccatcggcgacgactgggttgtcttcgacatcagggggctctacaggaacgttttctacagagagctcgcacaaaaggggcttaccgctgtccagctcctcgacctcttcaccggcgaccccgtgatcgatcccaagaagggcgttgtgaccttcagctacaaagagggggttgtgcccgtttttagtcagaagattgtccccaggttcaaaagcagggacacactcgagaagctcaccagccaaggtcccgtcgccttgctctccgtggacctcggccagaacgagcccgtggccgcaagggtgtgctctcttaagaacatcaacgacaagatcaccctcgacaacagctgcaggatttcattcctcgacgactacaagaaacagattaaagactacagggacagcctcgacgagcttgagatcaagattaggctcgaggccatcaacagcttggagaccaaccagcaagttgagataagagacctcgacgtgttcagcgccgacagggccaaagccaataccgtcgatatgttcgacatcgaccccaacctcatctcctgggactctatgtcagacgccagggtgtcaactcaaatatccgacttgtacctcaagaacgggggcgacgagtctagagtttactttgagatcaataacaagaggattaagaggtcagactacaacatctcccagctcgtcaggcccaagctttccgattcaaccagaaagaacctcaacgactccatctggaagctcaagaggacctccgaagaatacctcaagctctccaagaggaagctcgagctctccagagccgtcgtcaattatactattaggcagagtaagctccttagcggcatcaatgacattgtgatcatccttgaggatctcgacgtgaagaaaaagttcaacggcagagggatcagagacattggatgggacaactttttctcctccaggaaagagaataggtggttcatccccgccttccacaaggccttcagcgagctcagtagcaacagggggctctgcgtcatcgaagtcaaccccgcctggacctctgccacttgccccgactgcgggttctgcagcaaagagaacagggacggtatcaacttcacctgcagaaagtgcggagtgagctaccacgccgacatcgacgttgcaacattgaacatcgccagggttgccgtgcttggaaagcccatgtcagggcccgccgacagggagagactcggagacaccaagaagcccagagttgctagaagcagaaagaccatgaaaaggaaggacatctcaaactccaccgttgaggccatggttacagcc

SEQ ID NO: 153 - DNA, 2298 bp, Artificial
  synthetic
atggagaaggagatcactgagctcaccaagatcaggagagagttccccaacaagaaattcagcagcaccgacatgaagaaagcaggcaaacttttgaaggctgagggtcccgacgcagtcagagacttccttaacagttgccaggaaatcatcggtgacttcaagccccccgtcaagactaacatcgtttccatcagcagacccttcgaagaatggcccgtgtcaatggtcgggagggccatccaggagtattacttcagcctcaccaaagaggaactcgagtccgtccaccccggcacctcatccgaggatcacaagtccttcttcaacattacaggtctcagcaactacaactacactagcgtccagggactcaacttgatctttaagaacgccaaggccatctatgacgggaccctcgtgaaggccaacaacaagaacaagaagctcgaaaaaaagttcaacgagataaaccacaaaaggagtctcgagggcctccccatcatcacccccgactttgaagagcccttcgatgagaatggacacttgaataacccccccgggatcaacaggaacatatacggttaccaggggtgtgccgccaaggtgttcgtccccagcaagcacaagatggttagcctccccaaggaatatgagggatacaatagggatcccaatctctccctcgccggttttagaaacaggctcgagatcccagaaggggagcccgggcacgtgccctggttccagaggatggatatccccgagggacaaataggccacgttaacaagatacagaggttcaactttgtccatggcaagaactccgggaaagttaagttcagcgacaaaaccggcagggtgaagaggtatcaccacagcaagtacaaggacgcaaccaagccctacaagttcctcgaggaaagcaagaaggtgagcgccctcgacagtatcctcgccatcattaccattggggacgactgggttgtgtttgacatcagaggcctctacagaaacgtcttctatagagagctcgcccagaaaggcctcactgccgtccagctcctcgatctcttcactggcgaccctgtcatcgacccaaagaagggagtggtcaccttcagctataaggagggcgtggttcccgtgttctcccagaagatcgttcccaggttcaagtccagggataccctcgagaaactcacttcacaggggcccgttgcccttctctctgttgatctcgggcagaatgagcccgtcgccgccagggtctgttccctcaagaatataaacgacaagatcaccctcgacaacagctgtagaatctcctttctcgatgactacaagaagcaaattaaggactacagggactctctcgatgagctcgagataaagatcaggctcgaagccatcaactccctcgagaccaaccagcaggtcgagatcagggacctcgatgttttctccgccgatagagcaaaggccaacaccgtggatatgttcgacatcgatcccaacctcatctcctgggactccatgtcagacgccagggtgtccacacagatctccgacctctacctcaaaaacggtggcgacgagtccagggtttacttcgagatcaacaataagagaatcaagaggtccgattataacatctcacagctcgtcaggccaaagctctctgacagtaccaggaagaaccttaatgacagcatctggaagttgaaaaggaccagcgaggagtacctcaaactctccaagagaaagctcgagctcagcagggctgtcgttaactacaccatcaggcaaagcaagttgttgagtgggatcaacgacatcgtgatcattcttgaagatctcgatgttaagaagaagttcaacgggagggggattagagacattgggtgggataatttctttagctccaggaaagaaaataggtggttcatccccgccttccacaaagccttctcagaactctcatctaacaggggcctctgtgtcatcgaagtcaaccccgcatggacctctgcaacctgccccgactgcggtttctgttccaaggagaacagggatggcatcaacttcacctgtagaaagtgcggcgtcagctaccatgccgacattgacgtggccaccctcaacatagccagggtggccgttctcggcaagccaatgtccggtcccgccgatagggagaggctcggtgacaccaagaagcccagagttgccaggagcagaaagaccatgaagaggaaggacatctccaatagcaccgtcgaggccatggtgacagcc

SEQ ID NO: 154 - DNA, 2298 bp, Artificial
  synthetic
atggagaaagagatcaccgagctcacaaagattagaagggagtttcccaacaagaaattcagctccaccgacatgaagaaggcaggtaagctcctcaaggccgaaggacccgacgcagttagggattttctcaactcctgccaagagatcattggggatttcaaacccccagtgaagactaacattgtgagcatctctaggcctttcgaggagtggcccgtctctatggtggggagagccatccaagaatactacttctccctcaccaaggaggagttggagagcgtgcaccccgggaccagttctgaggaccacaagtctttcttcaatatcaccggcttgagcaattacaattacacctccgtccagggccttaatctcatcttcaagaatgctaaggctatttatgacggtaccctcgtcaaggccaacaacaagaacaagaagctcgagaagaaattcaatgagataaatcataagaggtccctcgagggcctccccatcatcactccagacttcgaggagcccttcgacgagaacggtcaccttaacaacccccccggcatcaacaggaatatctatggctaccaggggtgtgccgctaaagtcttcgtgccttccaaacacaagatggtgtccctcccaaaggaatacgagggctacaacagggaccccaacttgtccctcgccgggttcagaaatagactcgagatccccgagggggagcccggccacgtcccctggtttcagagaatggatatcccagagggccaaattggtcatgtgaacaagatacaaaggtttaacttcgttcacggcaagaacagcggcaaagtcaagttctccgacaagaccgggagggttaagaggtatcatcacagcaagtataaagacgccaccaagccctacaagtttctcgaggagtcaaagaaggtcagcgccttggactcaatcctcgccattatcaccatcggggacgactgggtggttttcgatatcagaggactctacaggaacgtgttctatagagagctcgcccagaaggggctcacagccgtccagcttctcgacctcttcaccggggatcccgtcatcgaccccaagaagggggtcgttacattctcctacaaggagggcgtggtgcccgtctttagccagaaaattgtccccagattcaagtccagggacaccctcgagaaattgacatcccagggacccgtggccctcctttccgtggacctcgggcaaaacgaacctgtggccgccagggtgtgctccctcaagaacatcaacgacaaaatcaccctcgacaactcctgcaggatcagttttcttgacgattacaagaaacagatcaaggattatagagacagcttggatgaattggagatcaaaatcagattggaagccatcaacagcctcgaaactaaccagcaggtcgagatcagagacctcgatgttttctctgccgacagagccaaggccaacaccgtcgacatgttcgatatcgaccccaacctcatcagctgggattcaatgtccgacgccagggtctccacccagatcagcgacctctaccttaaaaacggaggagatgagtctagggtctactttgaaatcaacaataaaaggatcaagaggagcgattacaacatctctcaactcgtgagacccaagctctccgacagtaccaggaaaaaccttaacgacagcatctggaagctcaagaggacctccgaggaatacttgaaactcagtaagaggaagctcgagctctccagggccgtggttaactacaccataaggcagagcaagttgttgtctggcatcaacgacatagtcatcatccttgaggacctcgacgttaaaaagaagttcaacggtaggggcatcagggatataggttgggataatttcttctcctctaggaaggagaacagatggttcatccccgccttccacaaggccttctccgagctcagctcaaataggggcctttgcgtcatcgaagtgaaccctgcctggaccagcgccacctgccccgactgcggcttctgcagcaaggagaacagggacggcatcaacttcacctgtaggaaatgtggcgtgtcctaccatgcagacatcgacgttgccaccttgaacatcgcaagggtggccgtgcttggcaaacccatgtctggaccagccgacagagagaggctcggcgacaccaagaaacccagggtggccaggagcagaaagaccatgaagaggaaagacatcagcaactcaaccgtggaggccatggtcaccgcc

SEQ ID NO: 155 - DNA, 2298 bp, Artificial
  synthetic
atggagaaggaaatcaccgagctcaccaagattaggagggagttccctaacaagaagttcagcagcaccgacatgaagaaggccggcaagctcctcaaggctgagggccccgacgccgttagggactttctcaacagctgccaggagataatcggcgacttcaagccccccgtcaagaccaacatcgtttcaatctctaggccctttgaggagtggcccgtttcaatggtgggaagggccatccaagagtattacttctccctcaccaaagaagagcttgaaagcgtccaccccggcaccagttccgaggatcataagtcctttttcaacatcaccgggctcagcaactacaattacacctctgtccagggcctcaacctcatattcaagaatgccaaagctatctacgacgggaccctcgtgaaggcaaacaacaagaataaaaagctcgagaagaaattcaacgagatcaaccacaaaaggagcctcgaggggttgcccatcataaccccagacttcgaggagcctttcgacgaaaacggtcacctcaataacccccccgggattaacagaaacatctacggataccaggggtgcgccgccaaggtcttcgtccccagtaagcataagatggttagcctccccaaagagtatgaagggtacaacagggatcctaatctcagcttggccggcttcaggaacaggctcgagatacccgagggggaacccggccacgtgccctggtttcagaggatggatatccccgaaggacaaatagggcacgtcaacaagatccagaggttcaactttgtgcacggcaagaacagtggcaaggtgaagttcagcgacaaaactgggagagtgaagagataccatcacagcaagtacaaggatgccactaagccttacaagttccttgaagagtcaaagaaagtctccgcactcgacagcatcctcgccatcatcaccatcggcgatgattgggttgtcttcgacatcagggggctctacagaaacgttttctacagggagctcgcccagaaagggttgaccgccgtgcaattgcttgatctttttaccggcgatccagtgatcgaccccaaaaagggcgtcgtgaccttctcctacaaagagggcgtggttcctgtgttctcccagaagatcgtgcctaggttcaaaagcagagacaccctcgagaagctcacatcccaggggcccgtggcactcctcagcgtcgacctcggccagaacgagcccgtcgccgccagggtctgttccttgaagaacatcaacgacaagatcaccctcgacaactcatgcaggatctccttcttggacgattacaaaaagcagatcaaggactacagggacagcctcgacgagctcgagatcaagatcaggctggaggccatcaacagcttggagaccaaccagcaggtggagatcagggacctcgacgtcttctccgcagacagggcaaaagccaacaccgtcgacatgttcgacatcgaccccaacctcatctcttgggatagcatgtccgacgccagggttagtacacaaattagcgacctctatctcaagaacggtggcgatgagtccagggtgtacttcgaaataaacaataagaggatcaagagatctgactacaacatcagccagctcgttaggcctaagctctccgatagtaccaggaaaaacctcaatgactcaatctggaagctcaagaggactagcgaggagtaccttaagctcagcaagaggaagctcgagctcagcagggccgtcgtcaactacaccatcaggcagagtaagcttctcagcggcatcaacgacattgtcatcatcctcgaggatttggacgtgaagaaaaagttcaacggtagaggcatcagggacatagggtgggataacttcttcagcagtaggaaggaaaacagatggttcatccccgcatttcacaaggccttctccgagctcagctccaataggggcttgtgcgtcatcgaagtgaatcccgcttggacaagcgcaacctgtcccgactgtggcttctgtagcaaagagaacagagatgggatcaacttcacctgcaggaagtgcggtgtgtcatatcacgccgacatcgacgttgcaacactcaatatcgccagagtcgccgtcctcggtaagccaatgtccggccccgccgatagggagagactcggggacaccaagaagcccagggtcgccagaagcaggaagaccatgaagaggaaagacatcagcaatagcaccgttgaggccatggttaccgcc

SEQ ID NO: 156 - DNA, 2121 bp, Artificial
  synthetic
atggcggatacgcccactctgttcacacagtttcttcgtcatcacttacctggccagaggtttcgcaaagatatccttaagcaggccggccgcatcttggccaataagggagaagatgccaccatcgccttcctccgcggaaagagcgaagagtctcccccggattttcaaccgcccgtaaagtgcccgatcattgcttgcagtcgcccgctgacagagtggcccatataccaggcatcagtggctatccaagggtacgtttatgggcagagtcttgctgagttcgaagcgtcggaccctggctgcagtaaggatggtctgttagggtggttcgacaagactggtgtgtgtaccgactatttctcggtccaaggtttaaatctgatctttcagaatgctagaaaacgctacattggcgtgcagacgaaggtcactaaccgtaatgagaagcgccacaagaagctgaagcggattaacgctaaacggattgctgaaggcctccctgagctgacatctgacgagcccgagtctgccctggacgagacgggacacctcatcgacccgccaggtctgaacacaaatatatactgttaccagcaggttagtccgaagcctttggcattgtcggaggttaaccagctgccgacggcctatgcagggtattcgaccagcggcgatgacccgatccagccaatggtcaccaaggaccggctctcgatttctaagggtcagccagggtacatacctgaacaccaaagggccttgctcagtcagaagaagcacaggcggatgcgcggctacggactgaaagcacgcgcgctactggtcatcgtccgcatccaggatgactgggccgttatagacctgcgctcactcttgaggaacgcctattggaggcgcatcgtacagactaaggaaccaagcaccataaccaaactgttgaagttggttaccggtgatccagtactggacgccacccgtatggtggctacttttacatacaagccgggaatagtgcaagtgcgctccgcaaagtgcctgaagaataagcagggttccaagctgttctctgagcggtacctgaacgagacagtgtctgtaacctctatcgacctgggcagcaataacctggttgccgttgcgacctatcgcctggttaatgggaataccccagagttgctccagaggttcactctcccatcgcatctcgttaaagactttgagaggtacaaacaggcgcatgacacgctcgaggactcaatccaaaagacagcggttgcctcccttcctcaggggcaacagactgagattcgcatgtggagcatgtacgggttccgagaggcccaagagagggtgtgccaagagctcggcctggcggacggtagcatcccctggaacgtgatgacggctactagtacgatcctcacggacctttttcttgcacgcggtggcgaccccaagaagtgcatgttcacctcagaaccgaagaagaagaagaacagtaagcaagtactctacaagatccgtgacagagcatgggcgaaaatgtataggaccctcctcagcaaagagacgagggaggcctggaataaggcgttgtggggcctaaagaggggtagtccagactacgcccggctcagtaagcgaaaggaggagctggccagaagatgtgttaattacaccatttcaacagctgagaaaagagcgcaatgcggccgtacgatcgtggccctcgaggacctcaacatcggctttttccacggcagagggaagcaagaacctggatgggttgggctattcactcgcaagaaggaaaataggtggctcatgcaggcgttgcataaagccttcctggagttggcgcaccataggggataccacgtgatcgaggtgaacccggcttatacgtcccaaacctgcccagtgtgcagacattgcgatccagacaacagggaccaacataacagggaggcattccactgcatcggctgtggattccgcgggaacgcggaccttgacgttgcgacgcacaacatcgcaatggtcgccataaccggtgagtccctgaagagggcccgtggctcggtggcgagcaagacaccacaaccgctcgccgcggaa

SEQ ID NO: 157 - DNA, 2121 bp, Artificial
  synthetic
atggcagacaccccaacgctgttcacgcagttcctccgacatcatctgccaggccagcgcttccggaaagacatactcaagcaagcaggccggatcctggccaataagggtgaagacgctacaatcgcctttctgcgggggaagtctgaggagtcgcctccggatttccaaccaccggttaagtgcccaataatcgcatgcagtagacccctgaccgaatggcccatataccaagcctctgtggcgatccagggatacgtgtatggtcagtctttggctgagttcgaggcttcagacccggggtgttctaaggacggcctgctcggctggttcgataaaactggcgtgtgcactgactacttcagcgttcaaggcttaaacctcatctttcagaatgcacggaagcgctacattggggtccaaaccaaggtcacaaatcgtaacgaaaagcggcataagaagttgaagagaataaacgctaaaaggatcgcggagggattgcctgagctgacctccgatgaaccagagtccgcactcgacgagacgggccacctcatcgaccctccaggccttaacaccaacatctactgctaccagcaagtatcgccaaagccgttggcgttgagtgaggtaaatcaattgccgacggcatacgcgggctattctacgtcgggagacgatcctattcagcccatggtgacgaaggaccgtctgagcatctccaaggggcagccaggatacatcccagagcaccagcgggccctcctttctcagaagaagcataggcgcatgaggggttacgggctgaaggcacgtgctctcctagtgattgttcgcatccaggacgactgggccgttattgatctgagatcgctgctcaggaatgcctactggcgcaggatcgtgcagacgaaagagccatcaaccatcaccaagctcctgaagctagtgactggggacccagtactagatgccacacggatggtggcaacttttacctacaaaccgggcatcgttcaggtccggagcgcgaaatgcctcaaaaacaagcagggctctaagctattctccgaaaggtacctgaacgaaaccgtgtccgttacctctattgatctcggatccaataatttggtggctgttgccacgtaccggctcgtcaacggaaacacgccggagctgctgcagaggtttacgttgccctctcacctggtgaaggatttcgagcgttataagcaggctcacgacaccctggaggattccatccaaaagacagctgtcgcctccttgccacagggccaacagactgaaatccgtatgtggtctatgtacggtttccgcgaggctcaagaacgggtgtgtcaagagttgggccttgccgacgggtctataccttggaacgttatgactgctacctctactatccttaccgacctgttcttggcgcgtggtggtgatccgaaaaagtgcatgttcacgagtgagcctaagaagaaaaagaactccaaacaggtcctgtataagatacgtgacagggcttgggctaaaatgtaccgcactctgctgtctaaggagacgagggaagcatggaacaaggccctttggggattgaagagaggtagccctgattacgcacgcctgtccaagcgtaaggaggagctcgcacgacgctgcgtcaattacaccatcagtacagctgagaagagggctcagtgcggtaggaccatcgtggccctggaggatcttaacattggattcttccatggaaggggtaaacaagagccggggtgggtcggactcttcacccgcaagaaggagaaccgctggctcatgcaagcattgcataaggccttcctcgaactagcacaccaccgaggctaccatgtgatcgaggtcaaccctgcgtatacatcccagacctgcccggtctgcaggcactgcgatcccgacaaccgtgatcagcataaccgcgaggcatttcattgcattggttgcggcttccgcggcaacgccgatctcgacgtggccacacacaacattgctatggttgccatcactggagagagcctcaagcgcgcgaggggctcagttgcatcgaagacacctcagcctttagcggcagag

SEQ ID NO: 158 - DNA, 2121 bp, Artificial
  synthetic
atggcggacaccccgaccctcttcacacagttcctcagacaccacttgcctggccagcgattccggaaggacatccttaagcaggccgggagaatcctagcaaacaagggggaagatgccacgatagctttcctcagaggaaagtctgaggagtcaccgccagatttccaaccgcctgtcaagtgcccgatcatcgcctgctccagacctctgacagaatggcctatctaccaggcttcagtcgctatacagggatatgtgtacgggcaatctctcgcggagtttgaagcctctgaccctggttgcagtaaagatgggctgctggggtggttcgataagaccggagtctgcacagattatttctcagtgcagggcctgaacctgattttccagaatgctagaaagcgatacattggcgtccagacaaaggtgactaaccgcaacgaaaagagacacaagaagcttaagagaattaatgcaaagaggatcgcggagggtttgcctgaactcacctctgatgaaccggaatcggcgctcgacgagaccggccacctgatcgacccacctgggttgaacacaaacatctattgttaccaacaagttagtcccaaaccgttggccctctctgaggttaaccaactccctacggcctacgccggctactcgacttccggcgacgacccaatccagccgatggtgactaaggaccgcttatctatcagcaaagggcagccagggtacatcccagaacatcaaagggctctcctttcgcaaaagaagcatcggcggatgagaggctacgggcttaaggcccgcgccttgttggttattgtgaggatccaagacgactgggcggtaatcgacctacgctcgctgctgcgtaacgcctattggcgccggatcgtacagactaaggagcccagcacaattacaaagctgctcaagctggttaccggcgaccccgtgctagatgcgacccggatggtcgcgacatttacctacaagcctggcatcgtgcaggtacggagcgccaaatgccttaaaaataagcaaggctcgaagctcttctctgaaaggtacctgaacgagaccgtgtctgtaacttcgatcgatttgggtagcaacaatctcgtggccgtggcaacctatcgcttagtaaacggtaacaccccagagctgcttcagaggtttaccttaccgtctcatctggttaaggactttgagagatacaaacaagctcatgacactctggaagattccatccagaagacagctgtggcatcactcccacaaggccagcaaacagagatacgtatgtggagtatgtacggattccgcgaggcccaggaaagagtctgccaggaattaggcctagccgacggcagtatcccttggaatgtgatgactgcgaccagcaccattctcacggacctctttctggcaaggggtggcgatcctaagaagtgcatgttcacctcggaacccaagaagaaaaagaactctaagcaagtcttgtacaagatccgggatcgggcttgggcaaagatgtacaggaccctgctgtctaaagagacccgggaagcatggaacaaagcgctctggggcctcaagcggggctctccggactatgctcggctctcgaagcgaaaagaagaattggccagacggtgcgtaaattacactatctccacagctgagaaaagagctcagtgcgggcgcacaattgtggccctagaagacctaaacatagggttcttccacggccgcggaaagcaagaacccgggtgggtgggtttgttcacaaggaagaaggagaacagatggctcatgcaggctttgcacaaggcgttcctcgagttggctcatcatcgaggatatcacgtcatcgaagttaacccggcatacacatcacagacatgccccgtttgccggcactgcgatccagataacagagatcaacacaacagggaagcatttcactgcattggctgcgggttccgcggcaacgcggatttggacgtggcaacacacaatattgcgatggtggccataacaggggagagcctcaagcgggccagggggagcgtggcctccaaaacccctcaacccttagctgctgag

SEQ ID NO: 159 - DNA, 2121 bp, Artificial
  synthetic
atggccgacaccccgaccctcttcacccagttcctccgccaccatctgccgggccagcgcttccgcaaggacatcctgaagcaggccggcaggatcctcgccaacaagggcgaggacgccaccatcgccttcctccgcggcaagagcgaggagtccccgccggacttccagccgccggtgaagtgcccgatcatcgcctgcagcaggccgctcaccgagtggccgatttaccaggcctccgtggccatccagggctacgtgtacggccagtccctggccgagttcgaggcctccgacccgggctgctccaaggacggcctcctgggctggttcgataaaaccggcgtgtgcaccgactacttctccgtgcagggcctgaacctgatcttccagaacgccaggaagaggtacatcggcgtgcagaccaaggtgaccaacaggaatgaaaagaggcacaagaagctgaagcgcatcaacgccaagaggatcgccgagggcctcccggaactcaccagcgacgagccggagagcgccctggacgagaccggccacctgatcgacccgccgggcctgaacaccaacatctactgctaccaacaggtgagcccgaagccgctggccctgagcgaggtgaaccagctgccgaccgcctacgccggctactccacctccggcgacgacccgatccagccgatggtgaccaaggaccgcctgagcatctccaagggccagccgggctacatcccggagcaccagcgcgccctgctctcccagaagaagcaccgcaggatgcgcggctacggcctgaaggcccgcgccctcctggtgatcgtgaggatccaggacgactgggccgtgatcgacctccgcagcctgctcaggaacgcctactggcgcaggatcgtgcagaccaaggagccgagcaccatcaccaagctcctgaagctcgtgaccggcgacccggtgctggacgccacccgcatggtggccaccttcacctacaagccgggcatcgtccaggtgaggagcgccaagtgcctcaagaacaagcagggctccaagctgttcagcgagaggtacctcaacgagaccgtgtccgtgacctccatcgacctcggcagcaacaacctcgtggccgtggccacctaccgcctcgtgaacggcaacaccccggagctgctccagcgcttcaccctcccgtcccacctcgtgaaggacttcgagaggtacaagcaggcccacgacaccctggaggactccatccagaagaccgccgtggcctccctcccgcagggccagcagaccgagatcaggatgtggagcatgtacggcttccgcgaggcccaggagagggtgtgccaggagctgggcctcgccgacggctccatcccgtggaacgtgatgaccgccacctccaccatcctgaccgacctgttcctcgcccgcggcggcgacccgaagaagtgcatgttcaccagcgagccgaagaagaagaagaactccaagcaggtcctgtataaaatacgcgaccgcgcctgggccaagatgtaccgcaccctcctgagcaaggagaccagggaggcctggaacaaggccctgtggggcctgaagaggggcagcccggactacgcccgcctctccaagaggaaggaggagctggccaggcgctgcgtgaactacaccatcagcaccgccgagaagagggcccagtgcggccgcaccatcgtggccctggaggacctgaacatcggcttcttccacggcaggggcaagcaggagccgggctgggtgggcctgttcaccaggaagaaggaaaataggtggctcatgcaggccctgcacaaggccttcctggagctggcccaccacaggggctaccacgtgatcgaggtgaacccggcctacaccagccagacctgcccggtgtgccgccactgcgacccggacaacagggaccagcacaacagggaggccttccactgcatcggctgcggcttcaggggcaacgccgacctcgacgtggccacccacaacatcgccatggtggccatcaccggcgagtccctcaagcgcgcccgcggcagcgtggcctccaagaccccgcagccgctggccgccgag

SEQ ID NO: 160 - DNA, 2121 bp, Artificial
  synthetic
atggctgacacgcctacgctgttcactcaatttttgcggcatcatttgccaggccaacggttccggaaggacatcttaaaacaggcgggtaggatccttgcaaataagggcgaagacgcaaccatagcattcctgaggggtaagtccgaagaaagcccaccggacttccagccgcctgtgaagtgtcctattatcgcctgctctagacccctaactgaatggccgatttatcaagcgtcggtcgctatccaggggtacgtctacggccagagtcttgccgagttcgaagcctctgatcctggctgctccaaggatggtttgctcggctggtttgacaaaacgggcgtgtgtacggactacttctcggtgcagggcttgaatctgatttttcagaacgctcgtaagcgatatataggggtccagactaaggtgacgaataggaatgaaaagcggcacaagaaactcaagcgaatcaacgcaaagcggatcgcggagggcttgccggaattgactagcgatgaaccggaatcagcacttgacgagacgggccacttaatcgacccccccgggttgaacaccaacatctactgctaccagcaggttagcccgaagcctctcgcactctctgaggtcaaccagctacctacagcctacgctggatactccacatctggggacgatccaatccagccaatggtgaccaaagacaggctatccatatcgaagggccaacccggatatatccccgaacaccagcgagccctgttgagccagaagaagcaccgcaggatgagaggttatggcctaaaggcccgcgcgctgctcgtcatcgtacgtatacaggacgactgggcggtgatcgacctccgcagccttctcaggaacgcttactggcggagaatagtgcagacgaaggagccttccactattactaagctactgaaactcgtaaccggtgatccagttctcgatgctactcgcatggtggcaacattcacatacaagccagggatcgtgcaggtgcgtagcgcaaagtgcttgaagaataagcagggatcaaagctgttctcagagcggtacctcaatgaaaccgtcagtgtgacctcgatcgatctcggatccaataacttagtcgctgtcgcgacgtatcgccttgtgaacgggaacacccctgaacttcttcagaggtttacccttccaagccacttggtcaaggattttgagagatataaacaggctcatgacaccctggaggattcaatacagaagactgcagtcgctagtctcccccaaggccagcagacggagatcaggatgtggtccatgtatggcttcagggaggcccaagaaagggtttgccaggaattgggtcttgcggacggctccataccctggaacgttatgacggccacgagcactattcttacagacttgtttttggctcgcggcggcgacccaaagaagtgcatgttcaccagtgagccgaagaagaagaagaattcaaagcaagtcctgtacaaaatccgggatagggcatgggctaaaatgtacaggaccctactcagcaaagaaacccgtgaggcatggaataaggccttatgggggctgaaacgcggcagtcccgattatgcgcgcctctccaagcgaaaggaggagctcgcgcgtaggtgcgtcaattacacaatttcaacggcggagaagcgtgcccagtgcgggcgtactatagtcgccttggaagacctgaacatcggtttcttccacggccgcggcaagcaagagccggggtgggttggccttttcacccgtaagaaggaaaacaggtggctgatgcaggccctgcataaggcctttctagagctcgcgcatcaccgcgggtaccacgttatcgaggtgaatccggcatacacttcccagacatgtcccgtctgccgccactgtgacccggacaatcgcgaccagcacaatcgggaagcgttccactgcatcggttgcggtttcagaggcaatgccgacctcgacgtggcaacccataatatcgctatggtggctattaccggcgagtcgttgaaacgggcgaggggctcagtggcctctaagaccccacagccacttgcagccgag

SEQ ID NO: 161 - DNA, 2121 bp, Artificial
  synthetic
atggctgacacaccgactttgtttactcagttcctgaggcaccacctgccgggtcaaagattccggaaagatatcctcaagcaggcaggtcgaattttggcgaacaagggggaagatgcgacgatcgcgttccttagaggcaaaagcgaggagtcccctccggatttccagcctcccgttaaatgccctattatcgcttgttcacgtccccttacggagtggccaatttaccaggcttcggtggcgatacaggggtatgtgtatggccaatcccttgcagagttcgaagcaagcgacccaggttgctcaaaggatggtttactgggttggttcgacaaaaccggagtttgcaccgactacttcagcgtgcaaggcctcaacctgatctttcagaacgctcgcaagcgttatatcggggtccagaccaaggtgacaaacaggaacgagaagcggcacaaaaagctaaagaggattaacgccaaacgtatcgccgaaggtcttcccgagcttacaagcgacgagccggaatccgcattggatgagacaggccatctgattgacccgcccggtttaaacactaacatatactgctatcagcaagtctcgcctaaacctctggccctctcagaggtaaaccagttgccaacggcctatgcagggtatagtacctcaggcgatgaccctatccagcctatggtcaccaaagaccgtctcagcatcagtaagggtcagccaggatacataccggaacaccaaagggctctgctttcgcagaagaaacaccggcgcatgaggggctacgggctaaaagcccgggcactcttggtcattgtgcgcattcaagatgactgggctgttattgacctgagaagccttcttcgtaatgcttattggcgtaggatcgtacagaccaaagagccatcaaccataacaaagctgttgaagttagtcacaggggatcccgtgcttgacgcaaccagaatggtggcgactttcacctacaagccaggtatcgtgcaagtcagaagtgctaagtgtcttaagaacaaacaaggtagtaagctattcagcgagcggtacttgaacgagaccgtgtccgttacgagtatagatttgggctctaataatttggtcgctgtggcaacctaccgcctcgtgaacggcaatacccccgaactgctccagagattcacgctcccaagccacctagtcaaggacttcgagcggtacaagcaagctcacgacacacttgaagattcaatccagaagactgctgtcgcgagccttccccagggtcaacaaaccgaaattcgtatgtggagcatgtacggtttccgcgaggcgcaggagcgcgtgtgccaggaactcggcttagccgacggcagcatcccatggaatgtgatgactgcgacgtctacaatcttaactgacctgttcctcgcaaggggcggtgacccaaagaaatgcatgttcactagcgaaccgaagaaaaagaaaaattccaagcaagtgctatacaagatccgtgaccgtgcgtgggccaagatgtaccggaccctcctctctaaggaaacccgcgaagcatggaataaggctttgtgggggctgaagaggggcagtccagattacgctaggctctcgaagaggaaagaagagcttgcgagaagatgtgtgaattacactattagcaccgccgagaaacgtgcacagtgcggtaggaccatcgtggcgctggaggacttgaacattggcttcttccacggcaggggcaagcaggagcccggttgggttggcctgttcacaaggaagaaggaaaatcgctggcttatgcaggcccttcacaaggcgttcctagagctagcgcaccaccgcggttaccatgttatagaagttaacccggcgtatacttcccagacttgcccggtgtgccgccactgcgatccagataaccgcgatcaacacaatcgagaggccttccactgcatcggctgcggcttccgagggaacgccgatctggatgttgctacgcacaatatcgcaatggtggcaattacgggggagtcacttaaacgcgcgagaggctccgtcgcgtcgaaaacccctcaaccccttgccgccgaa

SEQ ID NO: 162 - DNA, 2121 bp, Artificial
  synthetic
atggcggatacgcccacccttttcacacagttcctccgccaccaccttccagggcagcggttccgcaaagatattctgaaacaggctggtaggattttggctaataagggcgaggatgctactatagcattcctgcgtggaaagagcgaagagagcccaccggacttccagccgcccgttaaatgccccattatcgcctgcagcagacctttaacagagtggcctatctaccaggcgtcggtcgcgatccaggggtacgtctacggccagagcctcgccgaattcgaggccagtgaccctggatgcagcaaggatggtcttctgggttggttcgataaaactggtgtgtgcacagactatttctcggtgcagggactcaaccttatttttcaaaacgcacgcaagaggtatataggggttcaaaccaaggtcacaaaccgcaatgaaaagcgccacaagaaactgaagagaatcaacgcgaagaggatagctgagggcttgcctgaattgacctcagacgagccggaatcggctcttgacgagacaggacacctcatcgaccccccgggcttgaataccaatatctattgctaccaacaggtgagtcctaagccactggccttgagcgaggtgaaccagctgcccactgcctacgccggttactcaacctctggcgatgatccgatccagccaatggtcacaaaggaccggctcagcatctccaagggtcagccaggatacataccggagcaccagcgagccctgctgtcacagaagaaacaccgcaggatgagggggtacggccttaaggcacgggccctgcttgttatcgtgaggatccaggacgattgggccgtgattgacctgaggtctcttttaaggaatgcgtactggcgtaggattgtgcagacaaaggagccaagcacaatcactaagctccttaagctggttactggcgacccggtattggacgccaccagaatggtggcaacgtttacctacaagccgggtatcgtacaggttaggtccgccaaatgtcttaaaaataagcagggttcgaaactgttctccgagcgttatcttaacgagacagtctccgtcaccagcattgatctggggtcaaacaacctagtggctgtggcaacgtaccgcttggtgaatggcaacactccggagttgcttcagcggttcactttaccctcccatcttgtcaaggactttgagcgatacaagcaagcccatgatacccttgaggacagcatccagaagacggcggtcgcctccctcccccaggggcagcagaccgaaatccggatgtggagcatgtacggcttccgcgaggcacaggagcgggtctgtcaagaactgggcctcgctgatgggagcattccatggaacgtgatgacggcaaccagcacaattttgactgacctgttcttggcccgtggcggcgatccaaagaagtgtatgtttacttcagaaccgaaaaagaagaagaactccaagcaggtgttgtacaagatccgcgacagagcatgggctaaaatgtaccggacattgctgagtaaagagacgcgtgaggcctggaataaagcgttgtggggacttaagcgggggtcccctgactacgcaagattatcaaagcggaaagaggagctggcgaggaggtgcgtaaattacacgatctccacggcagaaaaaagagcacagtgcggacggacgattgttgcgctggaggatctgaatatcgggtttttccacggtcgcgggaagcaagaaccggggtgggtgggtctcttcacgcggaaaaaggaaaaccggtggcttatgcaggctctccataaggcgttcctcgagcttgcccaccatagaggctatcacgtaattgaagttaatccggcctacactagccaaacctgtcccgtgtgtcgtcactgtgacccggacaaccgcgatcaacataatagggaggcatttcactgtatcggttgcggattcaggggcaatgctgacctcgacgtggccacgcataatatcgctatggtggccattaccggcgaaagcttgaagagagccagggggtctgtcgcgtctaaaacgccccagccccttgcagcggaa

SEQ ID NO: 163 - DNA, 2121 bp, Artificial
  synthetic
atggctgacacacctacgctattcacccagtttctgcgccaccatctcccaggtcagagatttcgcaaggacatccttaagcaagccggtcggatcttagccaataaaggcgaggatgcgacgattgcattcctgcgtggcaagtccgaggaatcccctcctgacttccagccgccggtgaagtgccccataatcgcatgttctcggcctctgaccgaatggcccatttaccaggccagcgtggccattcagggctatgtgtacgggcagagtctggcggaattcgaggcaagcgaccctgggtgctcaaaagatggattgctgggctggttcgataaaacaggcgtatgcactgactacttctccgtccagggccttaatctgattttccaaaacgctagaaaacgctacattggtgtgcagacaaaggtgaccaaccggaatgagaagaggcataaaaagctcaagagaatcaatgcgaagcggatcgccgaagggctgcccgaactgaccagcgacgagccggagtcagccttggatgagactggccacctcatagaccctccaggtctgaacacaaacatttactgctatcaacaggtgtcaccaaagcccctcgccctaagcgaggtgaatcagttaccgactgcgtacgccggctactccacctccggtgacgacccaatccaacccatggtaactaaagacagactctcaatctctaaagggcagcccggatacattcccgaacaccaaagagctctcctgagtcagaagaagcacaggcgtatgaggggttacggcctcaaggctcgggcattacttgtgatcgttcgcatacaggatgattgggctgtcatagacctgcgctcccttttgcgcaacgcgtactggcgaaggatcgtccagaccaaggagccctccacgatcactaaactccttaagctagtgactggcgaccccgtgctggacgctacccggatggtagcgacctttacctacaagccgggcatagttcaagtccgctcagcgaagtgcctaaaaaacaaacagggctctaagctgtttagcgagaggtaccttaatgagacagtttccgtaacctctatcgacctcggttccaacaacttggttgcggttgccacctaccggctggtaaacggaaacacccctgaactactgcagagattcacccttccttcccatctcgtcaaggatttcgagcgctacaagcaggcgcatgatacgctggaagacagtatccagaagaccgcagtggcgtcacttcctcagggccaacaaacagagattcggatgtggtctatgtacggtttcagagaagcgcaggagcgggtctgccaggagttgggcctcgcagacggatccataccgtggaacgtcatgactgcaacctctaccatcttgaccgatttgtttttagcgcggggcggcgacccgaagaaatgcatgttcacttcagagcctaagaaaaagaagaattccaagcaggtactctacaagatcagggacagggcatgggctaaaatgtataggacactcttgtccaaggagacgagggaggcttggaataaggcactgtggggccttaagcgcggttctcctgactacgcacgtttatccaaaaggaaggaggagttagccagaaggtgtgttaactacaccatttccaccgcggagaagcgcgcgcagtgcgggagaaccatcgtggccctggaggatctcaacattggattcttccacggaaggggcaaacaagagccaggctgggttggtttattcacgcggaagaaggagaaccgctggctcatgcaagctctacataaggcctttcttgaactggcgcaccatcgggggtaccatgtgatagaagtgaacccagcatatacctcccagacctgcccggtctgccgacactgtgacccagacaacagagatcagcacaaccgcgaggcttttcactgtattggctgcggattccgcgggaatgccgacctggacgttgccacccacaatattgctatggtggccatcacaggcgagtcactcaaacgcgcacgcggctcggttgccagcaagaccccccagccacttgccgcggag

SEQ ID NO: 164 - DNA, 2121 bp, Artificial
  synthetic
atggccgacacacccacattgttcacgcagttcctaaggcaccacttaccaggccaacgctttcgcaaagacatcctgaagcaggccggcagaattctcgccaacaagggtgaagatgcgacaatcgcattcctcaggggcaaatccgaggagtcaccgccagattttcagccaccggtgaagtgccctatcattgcgtgttcccgtcccttgacagaatggcctatctaccaggcgtctgtcgctatccaaggatacgtctatggccaaagcctcgcggaattcgaagcgtctgatcctggctgcagtaaggatgggcttctgggatggttcgacaagaccggggtttgtaccgattacttctccgttcagggcctgaacttgattttccaaaacgccaggaaacggtacatcggcgtccagaccaaggtgacaaacaggaacgagaaacggcataagaagctgaagcggatcaacgcaaagaggattgcggagggccttccagagctaacttccgatgagcctgagagcgctctcgacgagacgggtcacctcatagaccctcccggcctcaacactaacatctattgttaccagcaggtaagccctaagccacttgccctctcagaggtcaaccagcttccaaccgcctatgccggatacagcacctcgggagatgacccgatacagccaatggtcacaaaagataggctctcgatctcaaagggccaacctgggtacatcccggaacatcaacgtgccctgctgtcgcagaagaagcaccgccgcatgaggggctacggattgaaagctcgggcgcttctggtgattgtacgcattcaggatgattgggcggttatcgacctcaggtctctcttgcgcaacgcgtactggagaaggatcgtgcagaccaaagagccttccactatcaccaagctgctaaaactggtgacaggcgacccagtcttagacgcaacgagaatggtcgccaccttcacttacaagcctggcattgtccaggtgagaagcgcaaagtgtctcaaaaacaagcagggctccaagcttttctcggagcggtatttgaacgagactgtgagtgtcaccagcatcgacctaggctcgaataacctggtggcggtggcaacctacaggttagtaaacggaaacaccccggagcttctccagcgctttacgctcccctcacatctggtgaaggatttcgagcgctataagcaggcccacgacacactcgaggatagcatccaaaaaactgccgtggctagcctaccacaaggtcagcaaacggagatccgcatgtggtccatgtacgggtttcgtgaggcacaggagcgggtctgccaggaacttggactcgctgatggttccatcccgtggaatgttatgaccgccactagtacaatcctcactgacctgttccttgcacgaggcggcgatccgaagaagtgcatgtttaccagcgagcccaaaaagaagaagaatagcaagcaagtactctacaagatccgggacagagcttgggctaagatgtatcgcacgctcctgagcaaggagacccgcgaggcctggaacaaggccctctggggtttgaagaggggcagccccgattatgctcgcctatctaagaggaaggaggagctggcgagacgatgtgtcaactacactatctccacggccgagaagagagctcagtgcggcagaacaatcgtggccctcgaggatctcaatattggctttttccacggtcgcggcaagcaggagcccggttgggtgggtctgttcacacgcaagaaagagaaccgctggctcatgcaggcgctgcacaaagcgtttctcgagcttgcgcaccacaggggttaccacgtgattgaggtgaacccggcttacacatctcaaacgtgcccggtctgtcggcactgtgatccggacaatcgcgaccaacacaaccgcgaggcatttcactgcataggatgtggtttccgtggtaacgcggacctagatgtggctacgcataacatcgcgatggtggcaataacgggcgaaagcttaaagagggcccgcggctcggtcgcctcgaagaccccacaaccgctggcggctgag

SEQ ID NO: 165 - DNA, 2121 bp, Artificial
  synthetic
atggctgatacgcccacgctcttcacacagttcttgcgtcaccatctgcctgggcagcgctttcgcaaagacatcctcaagcaggctggcaggattcttgcgaataagggagaggatgccactattgcctttctgaggggtaaaagtgaggaaagcccacccgactttcagcctcctgttaagtgccctatcatcgcctgttcaaggccactgacggagtggcccatctatcaagcgtctgtggctattcaaggctacgtctatgggcagtcacttgccgagttcgaagcgtccgacccggggtgcagtaaggacgggctcttgggctggtttgacaaaaccggtgtatgtaccgactacttctccgttcaagggttaaacctgatttttcagaatgcccgaaagcggtacattggagtacagacgaaggtaactaaccgcaatgagaaacgccacaagaaacttaagcgcatcaacgccaagcgtatcgccgagggcctgccggagctcaccagcgatgagccagagtccgcgctggatgagacgggccacttgatcgacccccctggcctgaacaccaacatttactgctatcagcaggtctctccaaagccgttggcccttagcgaagtaaaccaactgcccactgcctatgccggctactccaccagtggggacgacccaatccaacctatggtcacaaaagataggctctcaatctcgaaaggccagccgggatacattccggaacaccaacgggccctgctttctcagaaaaagcaccgccgtatgaggggttatggactcaaggcccgcgcactgctggtcatcgtgaggatccaggacgactgggcggtgatcgatcttaggagcttattgaggaacgcttactggaggcggatcgtccagactaaagagccatctaccatcacaaagttgctcaagttagtcacaggtgacccagtgctggacgcaacaagaatggtggccacttttacatacaaaccgggaatcgtgcaagttagaagtgccaaatgccttaagaacaagcagggttccaagctgttctccgagcggtacctgaacgaaacagtctccgtaactagcatcgacttgggctccaacaacctggtggctgtcgctacatatcgcttggttaatggcaacacccccgagttgcttcaacggttcacactaccatcccatctagtcaaggatttcgaaaggtataagcaggcgcacgatactctggaagactccatccagaagacggctgtggcctcactccctcaagggcaacagaccgagatccgaatgtggtcgatgtacggctttcgggaggcgcaggaacgcgtctgccaggagctggggctagccgacgggtccatcccttggaacgtgatgaccgccaccagcacaatccttacagatctgttcctggcgagaggcggcgacccgaagaagtgcatgtttaccagcgagcccaagaagaaaaagaactcaaagcaagttctctacaagatccgcgatagagcttgggctaagatgtacaggaccctcctctcaaaggagacgcgcgaagcttggaacaaggcgctctgggggttaaagaggggatctcctgactatgccagactgtctaagagaaaggaagaactggcgcggaggtgtgtgaattacaccatatccacggcggaaaagagagcgcagtgcggtcgtacgatcgtggcactcgaagatttgaatatcggtttttttcacggcagggggaagcaagagccgggttgggttgggctctttacacgcaaaaaggaaaaccgctggcttatgcaagccctgcacaaggcgtttcttgaactggctcaccatcgtgggtatcacgttattgaggttaacccagcctatacgtctcagacatgtcctgtgtgcaggcactgcgacccagataaccgggatcagcacaacagggaggccttccattgcattggatgcggctttcgaggcaacgctgacctagacgtcgccacacataatattgccatggtggcgattaccggcgaatcactcaaacgagcccgcggttctgtggcttcaaagacgccacaaccactcgcagctgag

SEQ ID NO: 166 - DNA, 2271 bp, Artificial
  synthetic
atgcccaagcccgccgtggagtcagagttcagtaaggtcctgaagaagcacttccccggagagcggtttcggtcatcgtacatgaaacggggtggcaagatactggctgcccagggagaggaagccgtggtagcttacttgcagggcaagtccgaggaggagcccccaaattttcagcccccggccaagtgccacgtggtgactaagtcgcgggactttgctgagtggccaatcatgaaggcttccgaggctatacagagatatatttatgccctgtcgaccacagaacgtgccgcttgcaaaccaggaaaaagctccgagtcccacgccgcttggttcgcggccaccggagtttcaaaccatgggtacagccatgtccagggtctgaatctgattttcgaccataccctgggaaggtacgacggtgtgctcaagaaagtgcagcttcggaacgagaaggcccgcgccaggttggagagtattaatgcgagcagagctgacgaggggctccctgagatcaaggccgaggaagaggaagtcgcgacaaacgaaactgggcacctgttgcagccgcccggtatcaatccgagcttctatgtgtatcagacaatctcccctcaagcctaccgaccgcgagatgagatcgtcctccctcccgagtatgctgggtatgtgcgcgatccaaatgcccccatcccactgggtgttgtgcgcaaccggtgcgatatacagaagggctgtcccggctacataccagagtggcagcgcgaagctggaactgccatatcacctaagaccggtaaggcggtaactgtaccgggtctcagcccaaagaaaaataaacgtatgagaaggtactggaggagtgagaaggaaaaggcccaagatgcgcttctggtgacggttcgcataggcacagactgggtcgtgatagacgtgagaggcctcctccgcaacgctagatggcgcactatcgcccccaaggacatctccctgaacgccctcctggatcttttcacaggtgaccctgtgattgacgtcagacggaacatcgtcacctttacctatacactggacgcctgcggaacttacgctaggaagtggactctcaagggtaagcaaacgaaagccaccctcgataagctcaccgcaacccagacagttgcattggtggctatagacttaggtcagacgaatccaatttccgcaggtatttcgcgcgtgacgcaggagaatggtgctctgcagtgcgagccgctcgaccggttcacactcccagacgatctcttaaaggacatttcagcatacaggatagcttgggacaggaatgaggaggagctcagggcccgctccgtggaggcgctccccgaggctcagcaggctgaagtccgagcattggacggcgtgtctaaggagacggcccgcacgcaactctgcgccgactttggcctggacccgaaacgcctgccatgggataagatgtcatcaaacaccacgttcatctcagaagccctgctttccaatagcgtttcgagggatcaggtgttcttcacgcccgcgcccaagaagggcgcgaagaagaaggcaccagtcgaagttatgcggaaggacaggacgtgggcgcgggcatacaagcccaggctttctgttgaagcccagaagctgaagaatgaggcgctgtgggctttaaagagaacctcccccgagtatttaaagctgtcgcgccgcaaggaagagctgtgccggcggagcatcaattatgtgatagaaaagactcgaagacgcacgcaatgccaaatcgtgatcccggtcatagaagacctgaacgttagattcttccatggctccggcaagaggctcccgggatgggataacttctttacagccaagaaggaaaaccgctggttcatccagggattgcacaaggcgttttcggacctccgcactcacagatctttttatgtcttcgaagtgcgcccagaacggacgtccataacctgtccaaagtgcggccactgtgaggtggggaaccgcgatggtgaggcgtttcagtgtctatcatgtggcaagacatgcaatgccgacttggacgttgcaacgcacaatcttacgcaggtggcactcactggaaagacgatgccgaagcgggaggaaccgagggacgcccagggtactgcccctgctcggaagacgaaaaaggcttccaagtctaaggctcccccagccgaacgcgaagatcagacacccgcccaggaaccgagccagacgtca

SEQ ID NO: 167 - DNA, 2271 bp, Artificial
  synthetic
atgcccaagcccgccgtcgagtcggaattctcgaaggtcctgaagaagcatttccccggtgaaaggtttcgcagctcttacatgaagcgcggtggtaagatcctcgcggctcagggagaagaagccgtagtagcttatctccaagggaagtccgaagaggagcccccaaacttccagccgcctgctaaatgccacgtggtgacaaaatcaagggatttcgccgagtggccaatcatgaaggcttccgaggcgatacaacgatacatttacgctttgtcaaccactgaaagggcggcgtgtaaaccaggcaaaagctctgagtcacacgcggcttggtttgcggccactggggtgtccaaccatggctatagtcacgttcagggactgaacctgatttttgatcatacgcttggtcgatacgacggcgtcttaaagaaagttcaattacgaaatgaaaaggccagggcgcggctggagtccattaatgcctcccgggcggatgagggactacccgagattaaggcagaggaagaggaggttgctactaatgaaaccggccacctgttgcagccccccggaatcaacccctcgttctacgtctaccagacgatctccccacaagcctaccgccccagagatgagatcgtgttgccaccggaatatgcgggctacgtgcgcgatcccaacgcgccaatccccctaggcgtggtccggaataggtgcgacatccaaaagggttgtcccggatacatcccagagtggcagcgggaagccgggactgccatctcgccgaaaacgggcaaggccgtgaccgttcccgggctcagtccgaagaaaaacaaaagaatgaggagatactggaggtccgaaaaggagaaggcacaggacgccttgctcgtgacggtgcgcattggaaccgactgggtggttatcgatgtgagagggctcctccgcaatgcacgctggcgaactatagcgcctaaggatatctccttgaacgcccttcttgacctttttacgggcgatccggttatagacgtacgaaggaacattgtcaccttcacctatacccttgacgcctgcgggacatacgcccgtaagtggaccctgaaaggaaaacaaacgaaagcgaccctcgacaagctcacggcgacgcaaacggtcgccctcgtggccatcgacctggggcagacaaatccgatctcagcaggcatctcacgggtcactcaagaaaacggcgcgcttcagtgtgaaccactagaccggtttaccctgccggatgacctcctcaaagacataagcgcctaccgcatagcgtgggacaggaacgaggaggaactgagggcccggtcagtcgaggccctcccggaggcgcagcaggccgaggtgcgcgccctggacggggtgtcaaaagagaccgctcgcacgcaactgtgcgcggattttggtcttgacccaaagcgcctcccatgggacaagatgagcagcaacacaacattcattagcgaagccttgctctcaaactccgtttccagagatcaagtttttttcacccccgcccctaaaaagggcgcgaagaaaaaggcaccggtggaggtgatgcgcaaggacagaacctgggcgcgggcctataagccacgcctcagcgtagaggcgcagaagcttaagaacgaggcgctctgggcgcttaagaggacatcccccgaatacttgaaactttcgcgaaggaaagaggagttgtgtcgccgcagcattaactacgtgattgagaaaacacgccggaggactcaatgtcagatcgtgatcccagttattgaagatcttaacgtgcggttcttccacgggtctggtaagaggttgccgggttgggataacttctttacggcgaagaaggagaataggtggtttatacaaggcctacacaaggcattctcagacctaagaactcacaggtctttctacgtcttcgaagtacgacctgaaagaacgtccatcacgtgcccaaagtgcggccactgcgaagttggcaacagggacggagaggcattccaatgtttgagttgtggaaaaacctgcaacgccgatctcgatgtggctacgcacaacctcacccaggtcgcattgaccggcaagacaatgccgaagcgagaagagccaagggacgctcagggaaccgctcccgccaggaagactaagaaggccagcaagtctaaggcaccccctgcagaacgagaggatcagaccccggcccaagagccctctcaaacatct

SEQ ID NO: 168 - DNA, 2271 bp, Artificial
  synthetic
atgccgaagccggctgtcgagagtgaattcagtaaggttttgaagaagcattttcctggcgaaagattccggagctcgtacatgaagagaggtggcaagatacttgcggctcaaggcgaagaggccgtggtggcctacctccagggtaagagcgaagaagagccacccaacttccaaccccctgccaagtgccatgttgtaaccaagtctagagacttcgcagagtggcccattatgaaggcgtccgaggctattcagcgatacatctacgcactcagcaccaccgaacgagcggcctgcaaacctggaaagtcgtccgaatctcacgcagcctggttcgcggccacgggggtgtccaatcacgggtactcccatgtccaaggattgaaccttattttcgaccacacccttggacggtacgacggggttcttaagaaggttcagctccgaaatgagaaagctcgcgcccgactcgaatcaattaacgcaagccgagctgatgaggggctgccagagatcaaggcagaggaggaggaggtggctacaaacgagacaggtcacttgctccaaccaccgggcattaacccgtccttctacgtttaccaaacaatcagccctcaggcctaccgacctcgtgatgaaatcgtgttgcccccggagtacgccggctacgtacgcgacccgaatgcccctataccactaggcgtcgtgcgcaacaggtgcgacatacagaagggctgcccggggtatatccccgagtggcaacgcgaagctggtaccgccatctcccctaaaaccggcaaggcagttacggtcccggggctgagtcccaaaaagaataagcgcatgcgccggtactggagaagcgagaaagagaaggcccaggatgcattactggtcactgtgagaattggaaccgactgggtggtcattgatgtgaggggccttctaaggaacgcaagatggcgcacaatcgcgccaaaagacatctcactgaacgctctgttggacctatttaccggtgacccagtgatcgacgttcgtaggaatatcgtcactttcacttacacactagacgcctgcggtacctacgctcgaaagtggactcttaagggcaagcaaactaaagctactttggataaactgaccgccacgcagacggtcgccctcgtggccatcgaccttggccagaccaatccgatcagcgctggcatttcccgggtcacccaggaaaacggcgcgctgcaatgcgagccgctcgataggtttacacttccagatgatctgttaaaggacatatctgcgtaccgcattgcttgggaccggaatgaagaagaactcagagcgcgatccgttgaagccctacccgaggcacagcaggcggaggttagagccctggacggggttagcaaggagaccgcgcgcacacagctgtgtgcggatttcggtctcgacccgaagaggctcccttgggataagatgagctctaacaccacgttcatttccgaggcattgctgtccaattcggtctctagggatcaagtcttcttcactccagcccccaaaaagggggcaaagaagaaagctccggtggaggttatgaggaaggatcgcacctgggcacgggcatacaagccgagactaagcgtcgaagcccagaagttgaaaaacgaagccctatgggctttgaaacggacttccccagaatacctcaagctttccagacgtaaagaagagttgtgcaggcgcagcataaactatgtcatcgagaaaacccggcgccgcactcaatgccagatcgtcattccagtgatcgaagacctcaacgtcagattcttccacgggtccggcaagagactgcccggatgggacaactttttcaccgcgaagaaggagaaccgctggttcatccaggggctgcataaggcattctcagacctgaggacacaccggagcttttacgtgtttgaggtgcggccggaacgaacttccatcacctgccctaaatgcgggcactgtgaggtcggcaatcgcgatggggaggcgttccaatgcctctcctgtggcaagacttgcaatgccgacctggacgtcgctacacacaaccttacgcaggtcgccctgacaggaaagaccatgccaaagagggaagagccccgagacgcccaaggtacagcgccggctcgcaagacgaaaaaggcttctaagtcaaaggctcctcctgcggagagagaggatcagaccccggcgcaggagcctagccagacgagt

SEQ ID NO: 169 - DNA, 2271 bp, Artificial
  synthetic
atgccgaagccggccgtggagagcgagttcagcaaggtgctgaagaagcacttcccgggcgagaggttccgctccagctacatgaagaggggcggcaagatcctcgccgcccagggcgaggaggccgtggtggcctacctccagggcaagagcgaggaggagccgccgaacttccagccgccggccaagtgccacgtggtgaccaagtccagggacttcgccgagtggccgatcatgaaggcctccgaggccatccagaggtacatctacgccctctccaccaccgagagggccgcctgcaagccgggcaagtccagcgagtcccacgccgcctggttcgccgccaccggcgtgagcaaccacggctactcccacgtgcagggcctgaacctcatcttcgaccacaccctcggccgctacgacggcgtgctgaagaaggtgcagctgaggaacgagaaggccagggcccgcctggaatcaattaatgccagcagggccgacgagggcctcccggaaattaaggccgaggaggaggaggtggccaccaacgagaccggccatctgctccagccgccgggaatcaacccgtccttctacgtgtaccagaccatcagcccgcaggcctaccgcccgcgcgacgagatcgtgctgccgccggagtacgccggctacgtgagggacccgaacgccccgatcccgctcggcgtggtgaggaacaggtgcgacatccagaagggctgcccgggatacatcccggagtggcagcgcgaggccggcaccgccatctccccgaagaccggcaaggccgtgaccgtgccgggcctcagcccgaagaaaaataagaggatgaggcgctactggaggtccgagaaggagaaggcccaggacgccctgctcgtgaccgtgcgcatcggcaccgactgggtggtgatcgacgtgaggggcctcctgaggaacgcccgctggcgcaccatcgccccgaaggacatcagcctcaacgccctcctggacctcttcaccggcgacccggtgatcgacgtgaggcgcaacatcgtgaccttcacctacaccctcgacgcctgcggcacctacgcccgcaagtggaccctcaagggcaagcagaccaaggccaccctggacaagctcaccgccacccagaccgtggccctggtggccatcgacctgggccagaccaacccgatctccgccggcatctcccgcgtgacccaggagaacggcgccctgcagtgcgagccgctcgaccgcttcaccctgccggacgacctcctgaaggacatctccgcctacaggatcgcctgggacaggaacgaggaggaactccgcgccaggagcgtggaggccctgccggaggcccagcaggccgaggtgcgcgccctggacggcgtgtccaaggagaccgcccgcacccagctctgcgccgacttcggcctggacccgaagaggctcccgtgggacaagatgtcctccaacaccaccttcatcagcgaagcattgctgagcaactccgtgtccagggaccaggtgttcttcaccccggccccgaagaagggcgccaagaagaaggccccggtggaggtgatgcgcaaggaccgcacctgggccagggcctacaagccgaggctgtccgtggaggcccagaagctcaagaacgaggccctctgggccctcaagcgcaccagcccggagtacctcaagctgagcaggcgcaaggaggagctgtgccgcaggagcataaactacgtgatcgagaagaccaggcgcaggacccagtgccagatcgtgatcccggtgatcgaggacctgaacgtgaggttcttccacggctccggcaagcgcctcccgggctgggacaacttcttcaccgccaagaaggagaaccgctggttcatccagggcctccacaaggccttcagcgacctgcgcacccaccgcagcttctacgtgttcgaggtgcgcccggagaggaccagcatcacctgcccgaagtgcggccactgcgaggtgggcaaccgcgacggcgaggccttccagtgcctgtcctgcggcaagacctgcaacgccgacctcgacgtggccacccacaacctgacccaggtggccctgaccggcaagaccatgccgaagagggaggagccgagggacgcccagggcaccgccccggccaggaagaccaagaaggccagcaagtccaaggccccgccggccgagagggaggaccagaccccggcccaggagccgtcccagaccagc

SEQ ID NO: 170 - DNA, 2271 bp, Artificial
  synthetic
atgcccaagccagctgtggaaagcgagtttagcaaagtgcttaaaaagcactttccgggcgaacgattccgctcgagctatatgaaacgcggcggtaagatcctagcagcccagggcgaagaggccgttgtagcgtaccttcaaggcaaaagcgaggaggagccgccgaactttcagccgcccgccaagtgccacgtagtcactaagtctcgcgatttcgccgagtggccgattatgaaggcttcagaagccattcagcgatacatttatgccctttcgaccactgagagggccgcctgcaagccgggcaaatcttcagagagccacgcggcctggttcgccgcgaccggcgtctccaaccacggatacagccatgtgcaaggtctcaaccttatattcgaccatacacttggcagatacgacggtgtcctgaagaaagtccaacttagaaacgagaaggcaagagcccggttagagagcataaacgcgtcaagagctgatgaaggcctgccggagataaaagcagaggaagaagaggtcgcaacaaatgaaaccggtcatctgttgcagccaccgggcatcaaccctagtttctatgtttatcagactatttctccgcaggcttacaggccgcgggatgaaatcgtattgccgcccgaatacgctggttatgtgcgggatcccaatgccccaatcccactcggagtagtcagaaaccgctgcgacatccagaagggctgcccaggctacataccggagtggcaacgggaggccgggacagctatctctccaaaaacaggtaaggccgtgacagtgccaggcctctctccgaagaagaataagcggatgcgccggtattggcgcagcgagaaggagaaggcgcaggacgcactactggtgacagtaagaattggtactgattgggtggtgattgatgtccgcggactgctccggaatgcccgctggcgcacaatcgcacctaaggatatatccttgaacgctcttctcgatctcttcactggcgacccagtgatcgatgtgcgcagaaacatcgttacattcacatacaccctagacgcgtgcggcacgtatgcccgcaagtggacacttaaggggaagcaaacaaaggctaccctggacaaactcacggcgacccagaccgtggcccttgtagcgatcgacttggggcagacgaatcccattagcgctggtataagtagggttactcaggaaaatggcgctctgcagtgcgaacctctggacaggttcacgcttccggacgatctattgaaggacatttcggcttatcgcatagcctgggaccgcaacgaggaggagcttcgtgcacggagcgttgaagcattaccagaggcgcagcaagcggaagttcgtgcattggatggtgtgtccaaggagacagcgcgaactcaactatgtgcggatttcggtctcgaccctaaacgtctgccgtgggacaagatgagctcgaatactacatttatctctgaggctctgttgtctaatagcgtctcccgcgatcaagtgttcttcacgccggccccaaaaaaaggagccaaaaagaaggccccggtggaggtgatgagaaaggacaggacttgggctcgagcgtataagccacgtttgtccgtggaggctcagaagctgaaaaacgaagcgttgtgggcactgaagcgcaccagcccggaatatctaaagctctcgagacgcaaagaggaactctgcaggcggtcgatcaattacgtcattgagaagacccgtcgacgcacccagtgtcaaattgttataccagtaatcgaagacctcaacgtgaggttcttccatgggtccggcaagagactgcccggctgggataacttcttcaccgccaagaaggagaaccgttggtttattcagggactgcacaaggccttctctgatctgagaactcaccggtccttctacgtgttcgaggtcaggcccgaacggacgagcatcacttgtccgaagtgcggacactgcgaagtcggcaaccgcgatggagaggcattccagtgtctctcctgtgggaaaacatgcaacgccgacctcgacgtggctacccacaaccttactcaagtggcgctcacgggtaaaacgatgcctaagcgtgaggagccccgggatgcgcaggggaccgctcccgctcgtaagaccaagaaggcgagcaagtcaaaggctcccccggccgaacgggaggaccagactccggcgcaggagccgtcccagacctcc

SEQ ID NO: 171 - DNA, 2271 bp, Artificial
  synthetic
atgcccaagccagcggttgagtcggaattctctaaggtcctcaagaagcactttcctggagagcgattcaggtcttcatacatgaaacgtggaggcaagattctggctgctcagggggaagaagctgtggtggcatacctccagggcaagtccgaggaagagcctcccaatttccagccaccggctaagtgtcatgtggtcaccaagtccagagactttgccgagtggccgatcatgaaggcttcggaggctatccaacggtacatttatgccctgtccactactgagagggcagcgtgcaagccaggaaaatcttcagagagccacgccgcctggttcgccgctaccggcgtctccaaccacggctacagtcacgtgcaaggacttaatcttattttcgaccatacactcggtcggtatgacggtgtgctcaagaaagtgcaactccgcaacgaaaaggccagggccaggctggaatccattaacgcctcgcgggccgatgagggactgcctgaaataaaagcagaggaagaggaggtagcgactaacgagaccggccatcttcttcagccacccgggataaatccctcattctatgtttatcaaaccatttcccctcaggcctaccgtccgagagatgagatcgtgctgccacctgaatacgcaggctacgtaagagatcctaatgcccccattccactgggcgtggtgaggaatagatgtgacatccaaaagggatgtcccggctatatccctgagtggcagcgcgaggcgggcacggccatctctccgaagaccggaaaggccgtgactgtaccgggcctgtcccctaagaagaataaacgtatgaggcgttattggaggtccgagaaggagaaggcacaggacgctttgcttgtaactgtccgcataggaactgattgggttgtgatagatgtgcgcgggctgctcaggaacgcacggtggcgcacgatagcaccaaaagacatatcgctgaatgcgctcttagacctgttcacgggcgacccggttattgacgtgcggaggaatattgtcaccttcacttacactctggatgcgtgcggtacatatgcgcgaaaatggactctgaagggcaagcagaccaaggccactcttgataagctcacagctacgcagaccgttgcactggttgccatagacctcggacaaacaaaccccatctccgcaggtatatccagagtcacccaggagaacggcgccctgcagtgtgagccactggatcggtttactcttccagacgaccttcttaaggacatctcagcataccggatcgcgtgggataggaacgaggaggagttgcgggctagatcagtcgaagcactccccgaagctcagcaggccgaggttagggcgctggacggcgtttcaaaggagaccgcccgcacacaactctgtgccgatttcgggcttgatcccaagcggctcccatgggacaaaatgagctctaacaccaccttcatatctgaggctctcctaagcaactctgtttcccgcgaccaagtcttcttcactcccgcgccaaaaaagggcgctaagaagaaggctcctgtggaagttatgcgcaaggaccgtacctgggctagggcttacaagcccaggctctcagttgaagctcaaaaactcaagaacgaagctttgtgggcgcttaagaggacctccccagagtacctcaagctctcaagacggaaggaggagctctgccgccggagtattaattatgtcattgaaaagacaaggagacgcacgcaatgccaaatcgtcatccccgtgattgaagatttgaacgttcggttctttcacggctcgggtaagaggcttccgggctgggacaactttttcacggcgaaaaaggaaaaccgttggttcattcagggtctccacaaggccttctcggacctcagaacacatcgttcattctatgtcttcgaggttcggcccgaacgtaccagcattacatgccctaaatgcggccactgcgaggtaggcaaccgtgacggcgaggcgttccaatgcttgtcgtgcggcaaaacctgtaatgctgatcttgacgtggccacacacaatcttacccaggtggcactaacgggaaagaccatgccgaagcgggaggaaccgcgcgatgcccagggcaccgccccggctcggaagacaaagaaggcgagcaagagcaaggcgccgcctgcggaaagagaggaccaaacacctgctcaggagccatcccaaacgagc

SEQ ID NO: 172 - DNA, 2271 bp, Artificial
  synthetic
atgccgaagcccgcagtggagagtgagttctcgaaagtgctcaaaaagcacttcccaggagaacgattccgctcctcatacatgaagaggggcggcaagatcctggccgcccagggtgaggaggcagtggtcgcttatcttcagggtaaatcagaagaggagccaccaaactttcaaccccctgccaagtgccatgtggtcaccaaatcccgagactttgccgagtggcccatcatgaaggcctcggaggcgatacaacggtacatctacgctctatccacgaccgaacgggcagcgtgcaaacctggtaaatcatctgaaagccacgccgcctggttcgctgcaacgggcgtctcgaaccacggctactctcacgttcaggggctgaatctcatattcgaccatacgctgggcagatatgacggtgttctcaaaaaggtccagttgaggaacgaaaaggctcgcgcgcgcctcgagtctatcaacgcgtcccgcgcggacgagggcctacccgagatcaaggcagaggaagaagaggtcgcgacgaatgagacgggccacttgttacagcctccggggattaacccgagcttctacgtctaccaaactatttcaccgcaagcataccggcctagggatgaaattgtcctgccgccagagtatgcaggctacgtgcgggacccaaacgcgccgattcctttgggcgtagtgagaaataggtgtgatatccagaaggggtgccccggctatattccagagtggcagagagaggcaggcacggccatttctccaaagaccggtaaggctgtcactgttccaggactatccccaaagaagaataagaggatgcggagatactggcgtagcgagaaggagaaggctcaggatgcactgctagtgaccgtgaggataggcacagattgggttgttattgacgtgaggggcctattgcggaacgctcgttggcggacgatcgcccctaaggatatatctctcaacgctctccttgacctgtttacgggggatccagtgattgacgtacgccgcaatattgttacgttcacttacactcttgatgcctgtggcacgtacgcccggaaatggaccctcaaaggcaagcagaccaaggccacgcttgacaaactcacagctacccagacggtcgctttagtggctattgacttgggacaaaccaacccaataagcgctggaatctcaagagtgacccaggagaacggcgctctgcagtgcgagccgctggacagatttactcttcccgacgacctcctaaaagacatctccgcctataggatagcttgggaccgaaacgaagaggagctgcgcgccaggtccgtcgaggcccttccggaggctcaacaagcggaggtgcgggcgctggacggagtgagtaaggagactgcgcgtacccagctgtgcgctgacttcggccttgatccgaaaaggctgccctgggacaagatgtccagtaacacgaccttcatctcagaggcgcttctctcaaattcggtctcccgagatcaggtgttcttcacgcccgcccccaagaaaggtgccaaaaagaaagcccccgttgaggtgatgaggaaagatcgcacttgggcccgcgcttacaaaccgcgcctctcggtggaggcgcaaaagttaaagaatgaggcgctttgggcgcttaagcgaacttctccagagtatcttaagctctcacggcggaaagaggagctgtgcagaaggagtatcaactatgtcatcgaaaagacgcgtcgtaggacccaatgccaaatcgttatccccgtcatcgaggatctgaacgtgaggtttttccacgggtctggcaaacggcttcccggctgggataattttttcaccgctaagaaagaaaatcgatggttcatccaggggttgcacaaggccttctcagatctcaggacccaccgcagcttttacgtcttcgaggttcgccctgagcgcacctctatcacttgccctaagtgcggtcactgcgaggttgggaaccgggacggcgaggcttttcagtgcctctcatgcggcaagacctgcaacgcggacctagatgtcgcaacgcataacctaacccaggtggcccttaccggcaagacgatgccgaagagggaagaacccagggacgcgcaagggacggcaccagcgcgtaaaacgaaaaaagcatcgaagtcaaaagcaccgcccgccgagcgggaagatcagacccccgcgcaagaaccgtcacaaacatcc

SEQ ID NO: 173 - DNA, 2271 bp, Artificial
  synthetic
atgccaaaacctgccgtcgaatctgagttctcaaaagttttgaaaaagcacttcccaggggaaaggtttcgttcttcgtacatgaagagaggaggaaaaatactggcagcccagggagaggaggctgtcgtagcctacttgcaaggcaagtctgaggaggagccaccaaatttccaaccgcctgcgaagtgccacgtcgttactaaaagccgggactttgcggaatggcccattatgaaggcgagtgaggccattcaaaggtatatctacgctctgagtacaaccgagcgtgccgcgtgtaaacccgggaaatcttctgagtcgcatgccgcctggttcgcggcaactggggtctccaaccatggctactctcatgtgcagggcctgaacctcattttcgatcatacgctcgggcgatacgatggagttttgaagaaggtccagttacggaatgagaaagcccgggctcgccttgagtctataaacgcttcgcgcgccgatgagggcctgccagagatcaaggcagaagaagaagaggtcgcaacaaacgagactggccaccttctccaaccccccggcatcaatccaagcttctatgtctatcagacgatctcaccacaggcataccggcctcgcgatgagatagtcttgccaccagagtacgctggttatgtacgcgacccaaacgctccgatcccgctgggcgtcgtccgcaatcgttgcgatattcagaagggttgtccgggatacatcccagaatggcagagagaggccggcaccgcaatttccccaaagacagggaaagcggtgaccgtgcctggcctctctccaaagaaaaataagagaatgaggcggtactggcggtcagagaaggaaaaggctcaggacgcgctcctggtgaccgttcgcatcggcacggactgggtggtgatcgacgtcagaggcctgctccgtaacgcgaggtggcgtacaatcgcccccaaagacattagccttaatgctctgctggacctctttacaggtgaccccgtcattgacgtcaggaggaacatcgtaactttcacttacaccctcgacgcttgcggaacctacgcgcgcaagtggaccctgaagggaaagcagactaaggccaccctcgataaacttacggccactcaaactgtcgccctggtcgctatcgacttgggccaaacgaatccaataagcgccggcatctcccgcgttacgcaggagaatggcgccctccagtgtgagccgctggaccgattcactcttcctgacgatttgttaaaagatatatccgcctacagaatagcgtgggaccgcaacgaagaggaactcagggcccgatcggttgaggccttgcctgaggcgcagcaggcggaggtgagagcgcttgatggcgtttctaaggagaccgcccgtacgcagctctgcgcggatttcgggctggaccctaagcggctgccctgggacaagatgtcaagtaatacaactttcataagcgaagcccttctttccaactctgtgtcgcgtgatcaggtgtttttcacgccggcacccaaaaagggtgctaagaagaaggcccctgtggaagtgatgcggaaggatagaacttgggcaagagcctacaagccccgtttatccgtggaggcccagaagctcaagaacgaggctttgtgggcgctcaagaggacgagccctgagtacctcaaactcagccgcaggaaagaagagctctgtagaaggagcatcaactacgtcattgagaagacaagaaggcgcacccagtgccagattgtgattccagtcatagaggacttgaacgtcagattctttcacgggtcgggtaagaggttgcccggctgggataatttcttcacagcgaaaaaggagaatcggtggttcattcagggtttgcataaggctttttccgatctacgcacacaccgaagcttctatgtgttcgaggtccggccagagcggacctcaattacatgccccaaatgcggccattgcgaggtcggaaaccgcgatggtgaggcctttcagtgcttgtcctgcggcaagacttgcaatgccgaccttgacgtggcaactcacaatctcactcaggtggcgcttactggaaagacaatgccaaaaagagaggagcctcgtgacgctcaaggaaccgcccctgcccgaaagaccaaaaaggcgtctaagagcaaggcaccgccagcggagagggaggaccagactccagcccaagagccatctcagacgtcg

SEQ ID NO: 174 - DNA, 2271 bp, Artificial
  synthetic
atgcccaagccagcagttgagagtgaattctcaaaggtcctcaagaagcattttccgggggagaggttccgcagctcctacatgaagaggggcgggaaaatccttgcggcacagggcgaggaggctgtagtggcctatttgcagggcaagtcagaagaggagccaccaaatttccagcctcccgccaagtgccacgtcgtcaccaagtctcgtgattttgcagaatggccgattatgaaggcttcggaggcgatccaacggtacatctatgcattgtcaaccacagaaagagctgcatgcaaaccaggtaagtcctccgagtcccacgctgcctggttcgctgccaccggcgttagcaatcatggctacagtcacgttcagggacttaacctcatctttgatcacacactcgggaggtacgatggcgtactgaagaaagttcagttaaggaatgaaaaggcaagggccagactggaaagcatcaacgccagtagggccgatgagggtttgcccgaaatcaaagctgaagaagaagaagttgctactaacgagacgggccatctccttcaacccccgggaataaacccatccttctatgtctaccagaccatctcaccacaggcataccggccaagggacgaaatcgtcctcccaccggagtacgccggctacgtcagggacccaaacgctccgatcccactcggagttgtgcgcaacagatgcgatatccagaaggggtgcccgggctacatccctgaatggcagcgggaggccgggaccgccataagccctaagacaggtaaagcggtgacggtacctggcctgtcacccaagaagaacaagaggatgagacgttactggaggtccgaaaaggagaaagcccaggatgctctgctcgtgacagtccggatcgggaccgattgggtcgtcattgacgtccgaggcctcttgagaaatgccaggtggcgtacgattgcgcctaaagacatctcccttaatgcgttattggatttgttcacaggcgacccagtgattgatgtccgcaggaacatcgtgaccttcacctacaccctagacgcttgcgggacctacgcacggaagtggacacttaagggcaagcaaaccaaagctacacttgacaaactgacagcaacccaaactgtggcgctggttgccatagacctgggccaaacgaacccgatttctgctggtatttcccgtgtcacgcaggaaaatggtgcgctgcagtgcgaacccctggaccgatttacactgcctgatgatctgctaaaggacatctctgcgtaccgaattgcttgggaccgcaacgaggaagagttgcgtgcccggagcgtcgaggctttaccggaagcccagcaagcggaggttagagcgttagacggcgtttcaaaggagacggctcgcacgcagctttgcgcggacttcggtctcgaccctaagcgcctcccctgggataagatgtctagcaataccacgttcatatcggaggcactattatcgaattccgtatctcgtgaccaagtgttcttcactccagcgcccaagaagggcgcgaagaaaaaagcacctgtagaggtgatgcgcaaggacaggacctgggcccgggcgtataagccacggttgagtgttgaagctcagaagctcaagaacgaggctctttgggcgctgaagcgcaccagtccggaatatctgaagctaagtaggcggaaggaggagttgtgcagacgctcaattaactatgtgatcgagaagactcgcaggcgaacccaatgtcagatcgtcattcccgtgatagaagatcttaacgttcgatttttccacggcagtggcaagcgactacccggctgggacaatttttttaccgctaagaaggaaaaccgctggttcatccagggattacacaaagctttctcggacttgaggacacacagaagcttctatgtctttgaagtaagacccgaaagaacaagtataacgtgtcccaagtgcggccattgcgaggtgggcaatagggacggggaggctttccaatgcctctcatgcggtaaaacttgtaacgcggacctggacgttgctacccacaacctgacacaagtggccctcacaggaaagactatgcccaagcgagaggagcctagggatgcccaaggtaccgcgccggctaggaaaacaaagaaggcatcgaagtccaaggccccgccagcagaacgggaagaccagacgccagcgcaggagcccagccagaccagc

SEQ ID NO: 175 - DNA, 2271 bp, Artificial
  synthetic
atgccaaagccagccgtagaaagcgaattctccaaggttttgaagaagcatttcccgggagagagatttagatcaagttacatgaagcggggtgggaaaatactcgccgcccagggcgaggaggcagtagtcgcatatcttcaggggaaatcagaggaggagccccccaactttcagccgccggcgaagtgccacgttgtcaccaagagccgtgatttcgcagagtggccaataatgaaggctagtgaagcgatccagcgctacatctatgcactcagcaccaccgagagagctgcttgcaagcctggcaagagttccgagtcccatgctgcgtggttcgctgctaccggcgtcagcaatcacggctactcccacgtccaaggcctcaatctgatcttcgaccatactctcgggcggtacgatggcgtgctgaagaaagttcagctccgcaatgagaaggcccgcgcaagactcgaatccatcaatgcatctagagcggatgaagggctccctgagataaaagcggaggaagaagaggtggccacaaacgaaacgggtcacctactccaaccgcccggcatcaatccgtccttctatgtttatcagactatttcaccgcaggcatataggccccgagacgaaatcgtgcttcctcccgagtatgctggttacgtgcgggaccctaacgcgcccattcccctcggcgtggtcaggaatcggtgcgacatacagaagggctgccctggctacattccggagtggcagagagaggctggaacagcgattagtcctaagactgggaaggctgttaccgtgccgggtctaagccccaaaaaaaacaagcgtatgcggcgctattggaggtctgagaaggaaaaagctcaagacgccttgcttgtcaccgtgcgcattgggacggattgggtggttattgacgtcaggggcctcctgcggaatgcgcgatggaggaccatagctccgaaagatatttcgctcaacgcgctgctggacctgtttacgggtgatccagtcatagacgtgaggcgcaatatcgtaactttcacgtatacgctggatgcttgtgggacatatgcacggaagtggaccctgaagggcaagcaaacgaaggcgacgctagataaactcacagccacccagaccgtcgccctcgtcgcaatcgatctaggtcagaccaaccctatttccgcaggtatcagtcgtgttacacaggaaaacggcgcgcttcagtgcgagccgttggatcgcttcacactcccagacgatctgctcaaggatatctctgcttataggattgcctgggaccggaatgaagaggagctccgtgctcgatccgtcgaggcgctgcctgaggcacaacaggctgaggtcagggcactagatggcgtgtccaaggagacagccaggactcagctctgtgcggactttggcctcgatcccaagaggctgccgtgggataagatgtcctccaatactacatttatctcggaagctctgctgtccaactcggtcagtagagaccaagttttttttacgccggccccgaagaagggcgccaagaagaaggcgcccgtggaagttatgcggaaggacaggacatgggcccgcgcttataagccccgcctctccgtggaggctcagaagctcaagaacgaagccctgtgggctttgaagcgcacatcacctgagtatctaaagctcagcaggaggaaagaagagctctgtcgcagatctatcaattacgtaatcgagaagacgaggcggcggactcaatgccaaatcgttataccagtaatagaggatttgaacgtgagattcttccatggatcaggcaaacgtctgccgggctgggacaacttttttactgctaagaaggaaaatcgatggtttatacaaggcctccacaaggctttctctgacttgcggacccatcgctccttctacgttttcgaagttaggcccgagagaacaagtattacctgcccgaagtgtggccattgcgaggttggtaaccgcgacggggaggcgtttcagtgcctttcgtgcggcaagacctgcaacgcggacttagatgtagcgacacacaacttgacacaagttgcactaaccggtaagacgatgccaaagagggaggagccgcgggacgcgcagggaacagctccagcgagaaagacaaagaaagcgagcaaatctaaggcgccaccggccgagagagaagatcagactccagctcaggaaccttctcagacgtcc

SEQ ID NO: 176 - DNA, 2298 bp, Artificial
  synthetic
atggagaaggagatcactgaactgacaaagattcggcgggaattcccgaataagaaattcagtagcaccgacatgaagaaggctggaaagttactcaaggcagaaggtccggatgctgtcagggatttcctcaactcatgtcaggagatcatcggcgatttcaaaccacctgtcaagacgaatatcgtcagcatctccaggcccttcgaggagtggcctgtgagtatggtcgggcgcgctatccaggagtactatttctctctcactaaggaggagctcgagtccgtgcaccctggtacctcttctgaggatcacaagagctttttcaatattacagggctgtccaattacaattacacatctgttcaaggcctaaatcttatcttcaagaatgccaaggcgatctacgatgggaccctcgttaaggccaacaacaagaataagaagctggagaagaagttcaatgagataaaccataaacgctccctggagggtctccctatcatcaccccggactttgaagagccattcgacgagaacggccatcttaataacccaccaggcattaacaggaatatatacggttatcaaggttgcgcagcaaaggtgttcgtaccctccaagcacaagatggttagcttacctaaggagtacgaaggatacaaccgtgatccaaatcttagcttggcaggcttccgtaatcgactagagatcccggagggcgagccaggtcacgtaccatggtttcagcgtatggacattccggaaggtcaaattggccatgtcaacaaaatccaaaggttcaacttcgtgcatggcaagaactccggtaaagtaaagttctcggataagacaggtagggtgaagcgttaccatcacagcaagtataaagatgcgacgaaaccgtataagtttctagaggagagcaagaaggtgagcgcgcttgacagcattcttgctattatcacaatcggcgatgattgggtcgtgtttgatatccgggggctgtatagaaatgttttctacagggagctagctcaaaagggcctaacggcggttcagctccttgacctcttcacgggcgaccccgtgatcgatccaaagaagggagtggtgacattctcatacaaggagggggttgtcccagtgttctctcagaagatcgttccccggttcaaaagccgcgatactttagagaagctgacctcgcagggtcctgtggcgctgctaagcgtcgatctggggcagaatgagcctgtcgcggccagggtgtgctctttgaagaatattaatgacaagataaccctagataattcatgcaggatctcctttttggatgactacaagaagcagatcaaggactacagagacagtttggacgagctcgagatcaagattcgtctcgaggccatcaatagcctcgagactaaccaacaggtagaaatccgcgatttagacgtgttctcagctgaccgcgccaaggccaacacagtagatatgtttgacatcgaccctaacttaatttcttgggactctatgagcgacgctcgggtcagtacgcagatctctgatctgtacctgaagaatggcggcgatgagagtcgcgtttactttgaaatcaacaacaagaggatcaagaggagcgactacaacatttctcagcttgtgcgacccaaactctcggacagcacccgcaaaaacctgaacgactcgatctggaagcttaagaggacttcggaggagtacctgaagctttccaagagaaagctggaattgtcaagggccgtggttaattacaccatccgccagagcaagttactctcgggtattaatgatatcgttataatactcgaggacttagacgtgaaaaaaaagttcaacggaagaggcattcgcgacataggctgggacaactttttttcttcacgtaaggagaataggtggttcatccccgcctttcataaggcgttttccgagctgagctcgaatagaggcctttgtgtcattgaggtcaatcctgcctggacatcagcgacgtgtcccgattgcggcttctgttccaaggagaaccgcgatggcatcaatttcacatgccgtaagtgcggcgtcagctaccacgcagatatcgacgtcgcgacgttgaacatcgccagggtggcggtacttggtaaaccaatgagcggcccagcggacagagaaagactcggggataccaaaaagccgcgggtagcgagatctcgcaagacgatgaagcggaaggacatcagcaattccaccgtggaagcgatggtcacagct

SEQ ID NO: 177 - DNA, 2298 bp, Artificial
  synthetic
atggagaaggagatcaccgagttgactaagattcgccgagaatttcctaacaagaagttctcgagcaccgatatgaagaaggctggaaagttgttgaaggccgaggggccggatgctgtgagggattttctcaattcctgccaggagattatcggcgatttcaagccgcccgtcaagactaacatagtttccatttcgcgcccttttgaagagtggcccgtgtcaatggtcgggcgcgctattcaggagtattactttagccttacaaaggaggagctcgagagcgtgcatcctgggacttccagtgaagaccacaagtccttcttcaacattaccggcctatcaaactacaattacaccagcgttcagggcctcaaccttatcttcaaaaacgcgaaggctatctacgacgggaccttggtcaaggccaataataaaaacaagaagcttgaaaagaagtttaacgagatcaatcacaagcgctcgctcgaaggattaccaatcataacgccagattttgaagagccctttgacgaaaacggccatctgaacaatccgcccggtataaatagaaatatctatggttaccaaggatgtgctgcaaaggtcttcgtgccatctaaacacaaaatggtgtccctccccaaggaatacgagggttacaaccgcgacccaaacttgtcgttggctggattcaggaatcggctagagatcccagaaggagagcctggtcacgtcccgtggtttcagcgcatggacatcccggaggggcaaattggtcatgtgaacaagatccagagattcaatttcgtgcacggaaagaactcgggcaaggtgaagttttctgacaaaacaggacgggtgaagcggtaccaccattcgaagtataaagacgccactaagccttataagtttctggaagagtcgaagaaagtgtctgcgttagacagtatcctcgccattattaccatcggggatgactgggttgtgtttgacattcgcggcctttataggaacgtgttctacagagagctggcacagaagggcttaacggccgtccagctgcttgacctttttacgggcgacccggtcatcgatccaaagaaaggcgtagtgacgttttcgtacaaggaaggcgtcgtccctgtgttctcgcagaagatcgtgcctcgctttaagtctcgagataccctggagaagttgacctcacaaggccctgtggcccttttgagtgtggatcttggtcaaaacgagccagtggcggcgagggtctgctccctcaagaatattaacgataagatcaccctggacaactcatgccggatttcattcctcgacgactacaagaagcaaatcaaagactaccgtgattccctcgatgagctcgagataaagataaggcttgaagccattaactcactggagacgaaccagcaagttgaaatcagagatcttgacgtcttttctgcggaccgggccaaggccaatacggtcgacatgttcgacattgatcccaacttgatatcgtgggacagtatgagtgatgctcgagtatcaacccagataagcgacctgtacttaaagaacggcggggacgaaagcagagtatacttcgagatcaacaacaaacgcattaaacggtcagactacaacatcagccagcttgtgcgccccaagttgagcgatagtacgcgcaagaacctgaatgattccatctggaagttaaagaggacctctgaggagtatttgaagctgtcaaaacgcaagctagagctctctcgcgccgtcgtaaattatacgattagacagtcgaaactattgagcggcattaacgacattgtaattattctggaggacctagatgtgaaaaaaaaattcaatggaaggggcatcagggatattggctgggacaacttttttagctcgaggaaagaaaatcgctggttcatcccggccttccacaaggccttcagtgaactctccagtaaccgggggctgtgcgtgatcgaggtgaatcccgcgtggaccagcgccacatgtcctgattgcggattctgttccaaagagaacagagatggtattaactttacttgcaggaagtgtggggtgagttaccatgctgacatcgacgtggcgaccctcaacatcgcaagggtggccgttcttggaaagcccatgtcaggcccggccgatcgtgaaaggctgggtgacacgaagaagccgcgggtcgctcgtagcagaaagacaatgaaaaggaaggacatttctaattcgaccgtggaggccatggttaccgca

SEQ ID NO: 178 - DNA, 2298 bp, Artificial
  synthetic
atggagaaggagataaccgagctcaccaagattcgtagggagttccctaacaagaagtttagcagcacagacatgaagaaagcgggaaagctcctgaaggctgaggggccagatgctgttcgagactttcttaactcgtgccaagagattatcggcgatttcaagcctcccgttaaaactaacatcgtgtccatatcgcgcccattcgaggagtggccggtgtccatggtcggaagagcgatacaggaatattacttttcacttaccaaggaggagttggaatccgttcaccccggcaccagttccgaagaccataagtctttctttaacattactggactctccaactacaactacacttccgttcagggccttaatctcattttcaaaaacgctaaggcaatctacgatgggacattggtcaaggccaataacaagaacaaaaagctcgaaaagaagtttaatgaaattaaccataagaggtcgctggaaggcctcccaattatcacccccgactttgaggaaccgttcgacgaaaacggccatctcaataacccgcctggaatcaatcggaacatatatgggtatcagggctgcgccgcgaaggtctttgtgccctctaaacataaaatggtatccctcccaaaggagtacgagggttataatagggatcccaacttgtcccttgcaggatttcggaaccggttggaaatccctgagggcgaacctgggcacgtgccgtggttccagcgtatggacataccagagggccagattgggcatgtgaataagatccagaggtttaattttgtccacggtaagaacagtggcaaggtgaagttcagcgataaaacaggacgtgtcaagcgctatcaccactccaagtacaaggacgccactaagccttacaagttccttgaggagtcgaaaaaggtctctgcactcgactcaatcctggcgatcattacaatcggcgatgattgggtggtattcgatatccgcggtctctaccggaatgttttctaccgggagctagcgcagaaaggcctcacggctgtacagctattagacctgttcaccggcgacccggttatagacccaaaaaagggggtcgttacattcagctacaaggagggcgtcgtgccagtcttctctcaaaagatagtgccgcgattcaagtctcgggacacgctggagaagctgacttcacaggggcccgtggcactgctcagcgtggatctcggccaaaacgagcctgtggcagccagggtctgctcactgaagaatatcaacgataagatcacacttgacaacagctgccgcatatcatttctcgacgattataagaagcagatcaaggactaccgagattccctggacgagctggagattaaaatcagactggaagcaatcaattcgttagagactaaccagcaagtcgagataagggatctggacgtattcagcgccgacagagctaaagcgaataccgtagatatgtttgacatcgacccgaatctgatctcctgggattcaatgagcgacgcgcgcgtcagtactcagattagtgatctctaccttaagaatggcggcgatgaatcccgcgtgtactttgagataaataacaagcgcatcaaaaggagcgattacaatattagccagcttgtccgcccaaagctcagcgacagcactcgcaaaaatctgaatgacagcatttggaaacttaagcgcaccagtgaggagtacctgaagctctctaagaggaagctggaactcagccgcgcagttgttaactatactatcaggcaatcgaaactcctctccgggattaacgacattgtgatcatcctggaagatctcgacgtaaagaagaagttcaacgggcgcgggattagagacatcggctgggataactttttctcttccaggaaagaaaacagatggttcatacccgcattccataaggccttctccgaattgtcttcaaaccgtgggctgtgtgttatagaagtgaacccagcgtggacatccgcaacctgcccagactgcggcttttgctcgaaggaaaacagggatggcatcaattttacatgtcgcaagtgcggcgtctcttaccacgcagatattgatgttgcgacgctaaatattgcccgggtggcagtcctgggaaagcccatgagcgggcctgctgatagggagaggctgggcgatacaaagaagccgagggttgcgcggtccaggaaaacaatgaagcgcaaggacataagcaacagtacggtggaggctatggtcacggcc

SEQ ID NO: 179 - DNA, 2298 bp, Artificial
  synthetic
atggagaaggagatcaccgagctgaccaagatcaggcgcgagttcccgaacaagaagttcagctccaccgacatgaagaaggccggcaagctgctcaaggccgagggcccggacgccgtgcgcgacttcctcaactcctgccaggagatcatcggcgacttcaagccgccggtgaagaccaacatcgtgtccatctcccgcccgttcgaggagtggccggtgtccatggtgggcagggccatccaggagtactacttctccctgaccaaggaggagctggagtccgtgcacccgggcacctccagcgaggaccataaatccttcttcaacatcaccggcctctccaactacaactacaccagcgtgcagggcctgaacctcatcttcaagaacgccaaggccatttacgacggcaccctcgtgaaggccaataataagaacaagaagctggagaagaaatttaatgaaatcaaccacaagcgctccctggagggcctcccgatcatcaccccggacttcgaggagccgttcgacgagaacggccacctgaacaacccgccgggcatcaacaggaacatctacggctaccagggctgcgccgccaaggtgttcgtgccgagcaagcacaagatggtgtccctcccgaaggagtacgagggctacaacagggacccgaacctgagcctggccggcttcaggaaccgcctggagatcccggagggcgagccgggccacgtgccgtggttccagaggatggacatcccggagggccagatcggccacgtgaacaagatccagcgcttcaacttcgtgcacggcaagaactccggcaaggtgaagttcagcgacaagaccggccgcgtgaagaggtaccaccacagcaagtacaaggacgccaccaagccgtacaagttcctggaggagtccaagaaggtgtccgccctcgactccatcctcgccatcatcaccatcggcgacgactgggtggtgttcgacatcaggggcctctaccgcaacgtgttctaccgcgagctggcccagaagggcctcaccgccgtgcagctgctcgacctgttcaccggcgacccggtgatcgacccgaagaagggcgtggtgaccttcagctacaaggagggcgtggtgccggtgttctcccagaagatcgtgccgaggttcaagagccgcgacaccctggagaagctcacctcccagggcccggtggccctgctctccgtggacctcggccagaacgagccggtggccgccagggtgtgcagcctgaagaacataaacgacaagatcaccctggacaactcctgccgcatctccttcctggacgactacaagaagcagatcaaggactaccgcgactccctggacgagcttgagattaaaatacgcctggaggccatcaactccctggagaccaaccagcaggtcgagatccgcgacctggacgtgttctccgccgacagggccaaggccaacaccgtggacatgttcgacatcgacccgaacctcatcagctgggactccatgtccgacgccagggtgtccacccagatctccgacctctacctgaagaacggcggcgacgagagcagggtgtacttcgaaatcaacaataaacgcattaaaaggtccgactacaacatctcccagctggtgaggccgaagctcagcgactccacccgcaagaacctgaacgacagcatctggaagctcaagaggacctccgaggagtacctcaagctctccaagcgcaagcttgagctgagcagggccgtggtgaactacaccatccgccagagcaagctcctgtccggcattaatgacatcgtgatcatcctggaggacctggacgtgaagaagaagttcaacggccgcggcatccgcgacatcggctgggacaacttcttcagctcccgcaaggagaacaggtggttcatcccggccttccacaaggccttctccgagctgtccagcaacaggggcctgtgcgtgatcgaggtgaacccggcctggacctccgccacctgcccggactgcggcttctgctccaaggagaaccgcgacggcattaatttcacgtgccgcaagtgcggcgtgtcctaccacgccgacatcgacgtggccaccctcaacatcgccagggtggccgtgctgggcaagccgatgtccggcccggccgaccgcgagaggctcggcgacaccaagaagccgcgcgtggccaggagccgcaagaccatgaagcgcaaggacatctccaacagcaccgtggaggccatggtgaccgcc

SEQ ID NO: 180 - DNA, 2298 bp, Artificial
  synthetic
atggagaaggagatcacggaactgaccaagattcgccgggagtttccgaataagaagttcagtagcaccgatatgaagaaggctggcaagctcctcaaggctgaaggtccggatgctgttcgagatttcctgaactcgtgccaggaaatcatcggtgattttaagccgcctgtgaagaccaacatcgtgtcgatctctcggcccttcgaggagtggccagttagtatggtgggccgcgcgatacaggagtattatttctctttgaccaaggaggaattggaaagtgtccatcccggaacgagctctgaggaccataagtctttcttcaatataacgggtctgtctaattataattacaccagcgtgcagggtttgaatctcatcttcaaaaatgccaaggcgatatacgatggtacccttgtcaaagctaacaataagaacaagaagttagagaagaagttcaatgaaataaaccacaagaggagcctggaagggctgccgattataactccagatttcgaggagccctttgatgagaacggccacctgaataatccccccggtattaacagaaatatctacggctaccagggttgcgccgccaaagtgttcgtgccctccaagcacaagatggtttcgcttcccaaggagtacgagggctacaacagagatcctaacctctcgttggccggtttccggaaccgccttgaaattcctgagggcgagcctgggcacgtcccatggtttcagaggatggacatcccggaaggccagatcggccacgtgaacaaaatccaacggttcaacttcgtacacggcaagaactccggtaaagtcaaattctccgacaagacgggaagagtcaaacgctaccaccacagtaaatacaaggacgctaccaaaccatacaagtttcttgaggaatcaaaaaaggtttcggccctcgactctattctggctatcatcactatcggcgatgactgggtagtgttcgacatccgcggcctgtaccgtaatgttttttaccgcgagctggcacaaaaggggctgactgccgtccaactgctggatctatttacgggagacccagtcatcgatcctaagaaaggcgtagtcacgttctcctacaaggagggggtcgtcccggtgttctcccagaagatcgttccgcgcttcaaatctcgcgacactcttgagaaactcacttcacagggaccagtcgctttgttatcagtcgatttgggccaaaacgaaccagtggcggctagagtttgtagcttgaaaaatatcaatgacaagatcactctcgataacagttgccggattagcttcctcgatgactataagaagcagatcaaggactaccgggacagcctagacgagctggagattaagatcaggttagaagccatcaacagtctcgaaactaaccagcaagtcgaaattagggacctggacgtcttctcagcggatcgtgcgaaggccaacaccgttgacatgttcgatattgatccaaatcttatctcttgggactccatgtcggatgcacgcgtctctacacaaatcagtgatttgtacctgaagaacggcggcgacgagtccagagtctacttcgagatcaacaacaagcgcattaagaggtccgattataacatctcccagctggtcagaccaaaactctccgattctacgagaaagaatcttaacgacagcatttggaagctcaagagaacctcggaggagtacctcaagctttccaagaggaaacttgagctttcgcgggctgtcgttaattacacgatacgccaatccaaactactctcgggtattaacgacatcgttatcattctcgaggacctcgatgtcaagaagaagttcaatgggcgtggcatccgtgacatcggctgggacaacttcttctctagccgcaaggaaaacaggtggttcatcccggcgtttcacaaggcgttcagtgagctctcctccaaccgtggtctgtgcgtaatcgaggttaaccccgcctggacctccgccacgtgccctgactgcggtttttgcagcaaggaaaaccgtgacgggatcaactttacctgcagaaaatgcggggtgtcctaccatgcagacatcgacgtagcaactctcaacatcgcgagagtggctgtcctgggaaagccaatgtcagggccggctgacagagaaagattaggcgacacgaaaaagcccagggttgcccgcagcaggaaaaccatgaaaaggaaggacatttccaatagtactgtggaggctatggttacggca

SEQ ID NO: 181 - DNA, 2298 bp, Artificial
  synthetic
atggagaaggagattacagagttgactaagataaggagagagttcccgaacaagaagttctcatcgaccgacatgaaaaaggcgggcaagctcctgaaggcggagggcccagacgccgtgcgggacttcttgaactcctgccaggagatcattggtgatttcaagccgccagtgaagacgaatattgtatcgatttctcgtccgttcgaggagtggcctgtttcaatggtaggccgagctattcaggagtattacttttctctcacgaaggaagaactggagagcgttcacccggggacatcatccgaagaccacaagtcatttttcaacatcacgggcctgtccaattacaattacacgagcgtgcaagggctcaacctgatcttcaagaatgccaaagccatctacgacggcacgctagttaaagcaaacaacaagaacaagaagttggagaagaagttcaacgagatcaaccacaagcgatccctggagggcctccccatcatcactcctgactttgaggaacctttcgacgaaaacgggcaccttaacaacccgcctggcatcaataggaatatctacggctaccaagggtgtgcggcgaaagtatttgtgccgtcaaaacacaagatggtctccctgccgaaggagtatgaaggctataatcgggacccgaatctctctctggcagggttcaggaaccgcctggaaatccctgagggtgagcctggccacgttccatggtttcagaggatggatatccctgagggccagataggccatgtgaataagattcaacgcttcaactttgttcatgggaagaactcgggcaaagttaagttctctgataagaccggcagggtgaagagatatcatcactcaaagtacaaggacgctacaaaaccctacaaattcctcgaggagtcgaagaaggtaagcgcactcgatagcatccttgcgattatcaccatcggggacgattgggtggtttttgacatccgtgggctgtacagaaacgtgttctaccgggagcttgctcagaaaggcttgactgcagtgcagttgctcgatctttttactggcgaccctgtgatcgatccaaagaagggcgtggtcacttttagttacaaggagggcgtggtgccagtcttttctcagaagatcgtgcctcggtttaagtcgagagacacactcgagaagctgacctcgcaaggacccgtcgctctgctgagcgtagaccttgggcagaacgagcctgtcgcagcacgggtttgttccctgaagaacatcaatgacaaaataacactggataatagctgtcgtataagtttccttgacgattataagaagcagattaaagattatcgggattctctcgacgagctggagataaagattaggctggaggcgattaactcgctggaaacgaaccagcaggtggagatcagggatctcgatgtcttctccgcggaccgtgcaaaggcgaatacagtggatatgttcgacatcgatcccaacctgatatcttgggacagcatgtcggatgcgagagtaagtacgcagatcagcgatttatacctcaagaacgggggggacgagtcccgtgtgtactttgagattaacaacaagcgcattaaacgcagcgactacaacatttcacagcttgtacgaccgaagctgtcggatagcactcggaagaacctcaatgactcaatttggaagcttaagcggacctcagaagagtatttgaaactgtcaaagcgcaaactggaactgagccgtgcggtcgttaactacactatccggcaaagtaagctcctttcagggatcaacgacatagtgatcatccttgaggacctcgacgttaagaagaaatttaatggccgtggtattcgggacatcggctgggacaactttttctccagtcgcaaagagaacaggtggttcatccctgccttccacaaagctttctcagagctgtcgtcgaatcgcgggctctgcgtgattgaggtcaatccagcatggacttccgctacgtgccctgattgtgggttctgctctaaggagaaccgcgacggtatcaactttacgtgcaggaaatgcggcgtctcttaccacgccgatatagatgttgcgactcttaacatcgcaagggttgccgtccttgggaagccaatgtcaggacctgccgacagagagcgtctgggcgacactaagaagcctagagtcgccaggtcccgtaagaccatgaaaagaaaggatatttctaactcgacagttgaggccatggtaaccgca

SEQ ID NO: 182 - DNA, 2298 bp, Artificial
  synthetic
atggaaaaggagataacggagcttactaagatccgccgcgagttcccaaacaagaagttcagcagtaccgacatgaagaaagcagggaagctcctgaaggctgaggggccggatgctgttagagacttcctgaacagctgccaggagattattggggacttcaagccgccggtgaagacgaacatagtgtcgatatcacgaccgttcgaggaatggcccgtgtccatggtaggaagggccatacaagaatactacttctcactgacaaaagaggagctggaaagcgtgcaccccgggaccagctctgaggatcacaagagttttttcaacatcactggattgagcaactataactatacgtcagtgcaaggcttgaatttgatcttcaaaaacgccaaagccatatacgatggcactctcgttaaggcgaacaacaagaacaagaaactggagaagaagttcaacgagataaatcacaagcgctcactggaagggctaccgattattacgccggacttcgaggagccattcgacgagaacgggcatttgaacaatcctcccggtattaacagaaatatttacggctatcaaggctgtgccgccaaagtttttgtgccaagcaaacacaagatggtcagtctgccgaaggagtatgaaggttacaaccgggaccctaatttatcactcgccgggttccgcaataggttagagatccctgagggtgagcccgggcacgttccgtggtttcagaggatggacatcccggagggccagattgggcatgttaacaagattcagcggttcaacttcgtgcacggcaagaactccgggaaagtgaaattcagtgacaagactggacgcgtcaagcgctatcaccacagcaagtacaaggatgccacgaagccgtacaagttcctggaggagtctaagaaggtttccgcactcgattccatcctcgcaattataactatcggagatgattgggtcgtctttgacatcagagggctttacagaaatgtgttttacagggagctcgcccagaagggtctcaccgctgttcagctgctggacctgtttactggcgatccagtgatcgaccctaagaaaggtgttgtcacgttcagctataaagagggggtcgtgcccgtctttagccaaaagatcgttccgcggttcaaatcccgggacacactcgaaaagctcacctcccagggtcctgtggccctactaagtgtagaccttggacagaacgagcctgtggcagcgcgcgtgtgcagtctaaagaatataaacgacaaaataaccttggataattcatgcaggatttccttcctcgatgactacaagaagcagatcaaggactatcgggacagccttgacgagctggagatcaagatcaggctggaggccatcaacagtctggaaactaaccagcaagtcgagatcagggatctcgatgtgttttctgctgatagggcgaaagcaaacaccgtagacatgtttgacatcgacccaaacctgatctcgtgggattccatgagcgacgcccgcgtcagtacccagatatctgatttgtacttaaagaacggcggagacgagtctcgcgtttactttgagatcaataacaagaggatcaagcgaagtgattataatatctctcaactggttaggccgaagctttcagacagcacgcggaaaaaccttaatgactcgatctggaaactcaagcgtacgtccgaagagtatctgaaactcagcaaacgaaagctggagttgtcacgggcggtggtgaactatacgattaggcagtccaaattgctatctgggataaacgacattgtcataatcttggaagacctggatgtgaagaagaaattcaacgggagaggaatcagggacattggttgggataacttcttcagttcccgcaaggagaatcggtggttcatcccagcatttcacaaagccttctcggaattgtcaagcaaccgtggtttatgcgtcatagaggtgaacccagcttggacttcagcgacgtgccccgattgcggcttctgcagcaaagagaaccgagacgggatcaacttcacctgccggaaatgcggcgtgtcgtaccatgcggacattgacgtggcaacgctcaatatcgcccgtgtggcagtgcttggcaagccaatgagtggtccggctgatagggagcgtctcggggataccaagaagccgagggttgcgcgctcccggaagactatgaagcgcaaggacatatccaatagtaccgttgaggcgatggtcacggca

SEQ ID NO: 183 - DNA, 2298 bp, Artificial
  synthetic
atggaaaaagaaatcacggaactcacaaagatccgtagggagttccctaataaaaaattctcgtccacagacatgaagaaggccggtaagcttctcaaggctgagggccctgacgcggtgcgcgacttcttgaattcctgccaggagatcatcggtgactttaaacctccagtgaagacgaacatagtctctatttctcgccctttcgaagaatggccagtgtcaatggtcgggcgcgcgattcaggagtattacttttctctcacgaaggaagagctagagtcagtgcacccgggtacaagctctgaggatcacaaatccttttttaacattaccggcttatccaactataactacacttccgtacaggggttgaacctgatcttcaagaatgcaaaggctatttacgatggcacgctcgtgaaggcgaataacaaaaataaaaagctcgaaaagaaattcaacgaaatcaaccacaagcgatccttagaaggcttgccgatcatcacacctgacttcgaggagccatttgacgagaacggtcacctcaataatccacccggaattaatcgtaacatctatgggtaccaaggatgtgcggccaaggtcttcgtcccgtcaaagcacaaaatggtgtcgctccctaaggaatatgagggctacaacagggacccgaacctctctcttgcagggttccgtaatagacttgaaattccagagggtgagccgggacatgtgccatggtttcaacggatggacattcccgaggggcagatcggccacgtgaacaagatacagaggtttaacttcgttcacggtaagaactccggcaaagtcaagtttagcgataaaactggcagagttaagcggtatcaccattccaagtataaggatgccaccaagccctataagtttctggaagagagcaagaaggtttccgcacttgattccattctcgcaatcatcaccatcggggacgactgggttgtttttgacatccggggactgtacaggaacgtcttttatcgggagctggcgcagaaagggcttacggccgtgcaattgctggatttattcactggcgatccggtgatcgacccaaaaaagggcgtcgtgaccttttcctacaaggaaggcgtggtccccgtttttagtcaaaagatcgtccctaggttcaaaagccgagacacattggagaaactcaccagccagggccctgtcgccttgctgtctgtcgatcttggacaaaacgaaccggtggctgcgcgagtctgcagccttaagaacattaacgataagattaccttggataactcatgtcggatcagtttcctggacgattataagaaacaaatcaaggactatagagattccttagatgagctcgagatcaagatccggctggaggctattaactcgctggagaccaatcagcaggtggaaatccgggacttggacgtattcagcgccgaccgggcgaaggcgaacacagtcgacatgttcgacatagatcccaaccttatcagctgggacagcatgtctgacgcacgggtctctacccagatcagcgacctctacctcaaaaatgggggtgacgagtctagagtgtactttgagatcaacaataagcggattaaacgctcggactacaatatcagccaattggtcaggccaaagttatccgactcgacaagaaagaacctcaatgattccatttggaagctgaagcgtacttctgaggagtatctgaagttgtctaagaggaagcttgagctgagccgggcagtagtgaattatactatccgccagagcaagcttcttagcggcattaacgacatcgtcatcatcctcgaagatttggacgtcaaaaagaagttcaatggacgcggtatcagagatattggctgggacaactttttcagcagcaggaaggaaaataggtggttcattccggcgtttcacaaggctttctcagagctgtcgtcaaacaggggattatgtgttatcgaggtgaaccctgcatggaccagcgcgacttgcccggattgcggtttctgctccaaggaaaatcgggacggcattaactttacttgccgcaagtgtggcgtctcataccacgcggacattgatgtcgctactctcaatattgcccgggtggcagtattgggcaaacctatgtccggccccgcagaccgggagcggttaggggacacgaagaaaccgcgcgtcgctagatcacgtaaaactatgaagagaaaggacatatctaactccaccgttgaggccatggtgacagca

SEQ ID NO: 184 - DNA, 2298 bp, Artificial
  synthetic
atggagaaggagatcaccgagttaaccaagatccggagagagtttccaaataaaaaattttctagcaccgatatgaagaaggcaggtaagcttctgaaggcggagggacccgacgcagtgcgtgatttcctgaactcgtgccaagagatcattggggatttcaaacctccggtgaagactaatatagtttctatcagtagaccttttgaggagtggccagtctctatggtgggccgggcaatccaggagtattacttctcccttacaaaggaagagctggaaagcgtgcatccagggaccagcagtgaggaccataagagcttctttaacatcacgggtcttagcaactataattacacaagcgttcaggggctcaatctaatcttcaagaacgcaaaagctatttatgacggtaccctggtcaaggcaaacaataagaataaaaagctggagaagaaatttaatgagatcaatcacaaacggtcactggagggactgccgatcataacccccgattttgaagagcccttcgatgagaacggtcatcttaataacccaccagggatcaaccgcaatatatatgggtaccaggggtgtgcggctaaggtctttgtgccctcgaaacataagatggtctccctcccaaaggaatatgaggggtacaaccgtgacccgaaccttagcctggcagggttccgcaatcgcttagagatccccgagggagagcccggtcacgtgccgtggtttcagaggatggacattcccgagggtcagatcgggcatgtcaacaagatccaaagattcaacttcgtgcacggcaagaactccgggaaggtcaagttttccgacaagaccgggcgtgtcaagcggtaccatcactccaagtacaaggatgccaccaaaccgtataagttcctagaggagtccaaaaaggtttccgctctggactctatccttgcgattatcacgattggggacgactgggtggtgttcgacataagaggcctgtaccgtaacgtattttatagggagcttgcacaaaagggcctcaccgcagttcaactgctggacctttttaccggcgatcctgttatcgacccgaaaaagggcgtggtgaccttctcttacaaagagggtgtcgtgcccgttttctcacagaagatagtccctcgcttcaaatcacgggacacgctcgagaagctgacatctcaaggtcccgtggccctcctgagcgtcgatctgggtcagaacgagccggtcgcggctagggtttgctcactgaagaacatcaacgacaagataacactcgataacagctgccggatctccttcctagatgactacaagaagcagattaaggactatcgtgattctctcgatgagttggagattaaaatcagactcgaagccattaactccctcgagacgaaccaacaggttgagatccgcgacctcgacgtattcagtgcggaccgggctaaggcaaataccgtcgacatgttcgacattgaccccaacctgatttcttgggatagcatgtcggacgcccgcgtgtctacgcagatttccgatctgtaccttaaaaatgggggagatgagagtcgtgtttacttcgagatcaataacaagcgcattaagcggtcagactacaatatctcgcagctggtcagacctaagctgtctgatagcacgaggaagaatctcaacgacagcatttggaagttgaagcgaacaagtgaagaatacttaaagctaagcaaacgcaagctggaactgtctcgcgcggtggttaactacacgatccgacaatcgaagcttctgtccgggatcaacgatatcgtcataattcttgaagacttggacgtgaaaaaaaagttcaatggtaggggcattcgcgacattgggtgggataacttcttttcctcccgcaaggagaatcgctggtttatccctgccttccataaggccttttccgagctgagtagtaatcgggggttgtgtgttatagaagtcaatcccgcatggactagcgccacttgtcctgattgcggattctgctccaaggaaaaccgggacggcatcaactttacgtgccggaagtgcggggtttcttaccatgctgacatcgatgtggcgaccttgaacatagctagagtagctgtcttgggtaagccgatgtccgggcctgcggacagggagagactgggcgacacgaagaagcctcgagtcgcaagaagtagaaagaccatgaagaggaaggacatatccaattctactgtcgaggcaatggtgaccgct

SEQ ID NO: 185 - DNA, 2298 bp, Artificial
  synthetic
atggagaaagaaataaccgagctcaccaagatcaggcgagagtttcccaataagaagttctccagcaccgacatgaaaaaggctggtaagcttctcaaagccgagggtccggatgcagtcagagattttttgaactcctgccaggagataataggtgactttaagccaccagtcaagacaaacattgtttctatcagccgcccctttgaggagtggccggtgagcatggtgggcagggcgatccaggagtattatttcagcctcactaaggaagagctggaaagcgttcatcctggcaccagctccgaagaccacaaaagtttcttcaacatcacgggtctctccaattataattacaccagcgtgcaaggattgaatctgatttttaagaacgctaaggcgatttacgacggaaccctcgttaaagccaataacaagaacaagaagttggaaaagaagtttaacgaaatcaatcataagaggagcctggagggcctgccgatcatcacccctgacttcgaggagccctttgacgaaaatggacatttgaacaacccaccaggtataaacaggaacatctacggttaccaggggtgcgctgccaaagtgttcgtaccatccaagcataagatggtgtcgcttcccaaagagtatgaaggatataatcgagacccaaacctttcccttgctggtttccgcaaccggctggagatcccagagggtgagccaggacatgtgccgtggtttcaaagaatggatataccggagggccaaattggacatgtcaataagattcagcgcttcaatttcgtccatgggaaaaatagcgggaaggtgaagttttcagataagaccgggcgagtgaaacggtaccaccacagtaagtataaggatgcgacaaagccatataaattcttggaagagagcaaaaaggtttcggccctcgattcaatactggcaatcatcactatcggtgatgactgggtcgtgtttgacattcgcgggctatataggaatgttttctaccgcgagcttgcgcagaaggggctcaccgccgtgcagctgctggacctctttacgggtgatcccgtcatcgatcctaagaaaggcgtggttacgtttagttataaagaaggggtggtgcccgtcttcagtcaaaaaattgtgccaaggttcaagtcacgtgatacattggaaaagcttacgtctcaaggcccggtagccttgctctccgtggacctaggccagaacgagccagtcgctgcacgcgtgtgttcacttaagaacattaacgacaaaatcactctcgacaacagctgccgcatttcatttctggacgactacaagaaacaaatcaaggactacagggactcgctggatgagctcgaaattaaaatccggctggaagccatcaactcactggagaccaaccaacaggttgagattagagatctagacgtcttctcggcggaccgagccaaagccaacacagtggatatgtttgacattgacccaaacctgatcagttgggactctatgtccgatgcgcgcgtatcaacacagatctctgacctctacctcaaaaatggaggtgacgagtcccgcgtttactttgagatcaataataagcgcatcaagcgttcggactacaatattagccagctggtaaggcccaagctttccgacagcacacgtaaaaacctgaatgattcgatttggaaactcaagcgcacctcggaggaatacctaaaactctcgaagcgaaaactcgagctttcccgggcggtcgtaaactacacgattaggcaaagtaaactcctctccggtattaacgatattgtaattatccttgaggaccttgatgtaaagaagaaattcaacggacgaggcatccgggatatcggctgggataacttcttttcttcgcgcaaagaaaaccggtggtttatcccggccttccataaggctttcagcgagctttcttccaaccgagggttgtgcgtgatagaagttaacccggcctggacgagcgcaacctgcccggattgtgggttctgtagcaaggagaacagggatgggatcaacttcacgtgtaggaagtgcggggtgtcctaccacgccgatatcgacgttgccacgctcaatatcgcccgcgtggccgtgctgggcaagcccatgtcgggccctgccgatagagagaggctgggggacactaagaaaccgcgtgtcgcacgaagccgcaagacgatgaagaggaaggatatctccaattccaccgtcgaggcaatggttaccgcg

SEQ ID NO: 186 - DNA, 36 bp, Artificial
  synthetic
ggagagatctcaaacgattgctcgattagtcgagac

SEQ ID NO: 187 - DNA, 36 bp, Artificial
  synthetic
gtcggaacgctcaacgattgcccctcacgaggggac

SEQ ID NO: 188 - DNA, 36 bp, Artificial
  synthetic
accaaaacgactattgattgcccagtacgctgggac

What is claimed is:

1. A method of modifying an endogenous soybean gene in a soybean genome comprising:
   (a) introducing a guide RNA or a polynucleotide encoding a guide RNA directed to a target editing site in the endogenous soybean gene and optionally a donor template DNA molecule having homology to the target editing site into a soybean plant cell comprising a synthetic polynucleotide encoding an Cas9 RNA-guided endonuclease (RGE) or Cas9 RNA guided nickase (RGN) having at least 99% sequence identity to SEQ ID NO: 1, wherein said synthetic polynucleotide:
      (i) has more than 80% identity across the entire length of SEQ ID NO: 3 and a GC (guanine and cytosine) content greater than 48% and a soybean codon adaptation index (sCAI) which is decreased by a value of 0.02 to 0.03 in comparison to the sCAI of the soybean codon-optimized reference polynucleotide of SEQ ID NO: 2; or
      (ii) has more than 80% sequence identity across the entire length of SEQ ID NO: 3 and a soybean codon adaptation index (sCAI) which is decreased by a value of 0.02 to 0.03 in comparison to the sCAI of a soybean codon-optimized reference polynucleotide of SEQ ID NO: 2; and
   (b) selecting a modified soybean plant cell, soybean plant, soybean plant part, soybean tissue, or soybean callus comprising a modification of the endogenous soybean gene.

2. A soybean plant cell comprising a synthetic polynucleotide encoding a protein comprising a Cas9 RNA-guided endonuclease (RGE) or a Cas9 RNA-guided nickase (RGN) having at least 99% sequence identity to SEQ ID NO: 1, wherein said polynucleotide has:
   (a) more than 80% identity across the entire length of SEQ ID NO: 3 and a GC (guanine and cytosine) content greater than 48% and a soybean codon adaptation index (sCAI) which is decreased by a value of 0.02 to 0.03 in comparison to the sCAI of the soybean codon-optimized reference polynucleotide of SEQ ID NO: 2; or
   (b) more than 80% sequence identity across the entire length of SEQ ID NO: 3 and a soybean codon adaptation index (sCAI) which is decreased by a value of 0.02 to 0.03 in comparison to the sCAI of the soybean codon-optimized reference polynucleotide of SEQ ID NO: 2.

3. The soybean plant cell of claim 2, wherein the synthetic polynucleotide comprises an RNA molecule that encodes the RNA-guided endonuclease protein or RNA-guided DNA binding protein.

4. The soybean plant cell of claim 2, wherein the soybean plant cell further comprises a guide RNA or a polynucleotide encoding a guide RNA.

5. The soybean plant cell of claim 2, wherein the soybean plant cell further comprises a donor template DNA molecule having homology to the target editing site.

6. The soybean plant cell of claim 2, wherein the synthetic polynucleotide is operably linked to:
   (a) a promoter that is operable in a soybean plant cell;
   (b) a 5' untranslated (UT) sequence and/or a 3' untranslated (UT) sequence, optionally wherein the 5' UT and/or 3' UT optionally have (i) a GC (guanine and cytosine) content greater than 47 or 48%; (ii) a melting temperature (Tm) greater than 89 or 90 degrees Celsius; or a combination of (i) and (ii);
   (c) a polyadenylation sequence; and/or
   (d) a second polynucleotide sequence encoding a nuclear localization signal (NLS), a chloroplast transit peptide (CTP), an epitope tag (ET), a transcriptional activation domain (TAD), a transcriptional repressor domain (TRD); or combination thereof; optionally wherein the second polynucleotide sequence(s) have (i) a GC (guanine and cytosine) content greater than 47 or 48%; (ii) a melting temperature (Tm) greater than 89 or 90 degrees Celsius; (iii) a soybean codon adaptation index (sCAI) which is lower than the sCAI of a second soybean codon-optimized reference polynucleotide encoding the NLS, CTP, ET, TAD, or TRD; or any combination of (i), (ii), and (iii).

7. The soybean plant cell of claim 2, wherein the synthetic polynucleotide is operably linked to a heterologous polypeptide encoded by a third polynucleotide sequence and wherein the heterologous polypeptide exhibits one or more enzymatic activities selected from: nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity, and/or glycosylase activity.

8. A soybean plant, plant part, tissue, or callus tissue comprising the soybean plant cell of claim 2.

9. The soybean plant part of claim 8, wherein:
   (a) the part is a stem, pod, leaf, bud, root, or seed;
   (b) the tissue is a callus, meristematic, or embryonic tissue; or
   (c) the tissue is an embryonic callus tissue.

10. A method for obtaining the soybean plant cell of claim 2 comprising:
    (a) introducing into the soybean plant cell the synthetic polynucleotide encoding the protein comprising the Cas9 RNA-guided endonuclease (RGE) or the Cas9 RNA-guided nickase (RGN) having at least 99% sequence identity to SEQ ID NO: 1, wherein said polynucleotide has a GC (guanine and cytosine) content greater than 48 or 50%; a melting temperature (Tm) greater than 89 or 90 degrees Celsius; a soybean codon adaptation index (sCAI) which is decreased by a value of 0.02 to 0.03 in comparison to the sCAI of a soybean codon-optimized reference polynucleotide encoding the RGE; and (b) selecting a plant cell comprising the synthetic polynucleotide.

\* \* \* \* \*